(12) United States Patent
Plouét et al.

(10) Patent No.: US 7,999,072 B2
(45) Date of Patent: Aug. 16, 2011

(54) MUTATED NETRIN-4, FRAGMENTS THEREOF AND THEIR USE AS MEDICINES

(75) Inventors: Jean Plouét, Paris (FR); Monica Alemany, Paris (FR)

(73) Assignees: Centre National de la Recherche Scientifique (CNRS), Paris (FR); IVS Institut des Vaisseaux et du Sang, Paris (FR)

( * ) Notice: Subject to any disclaimer, the term of this patent is extended or adjusted under 35 U.S.C. 154(b) by 1067 days.

(21) Appl. No.: 11/791,274

(22) PCT Filed: Nov. 22, 2005

(86) PCT No.: PCT/FR2005/002898
§ 371 (c)(1),
(2), (4) Date: Jul. 13, 2007

(87) PCT Pub. No.: WO2006/054000
PCT Pub. Date: May 26, 2006

(65) Prior Publication Data
US 2010/0183588 A1 Jul. 22, 2010

(30) Foreign Application Priority Data

Nov. 22, 2004 (FR) .................... 04 12362
Nov. 22, 2004 (FR) .................... 04 12364

(51) Int. Cl.
| | |
|---|---|
| C07K 1/00 | (2006.01) |
| C07K 14/00 | (2006.01) |
| C07K 17/00 | (2006.01) |
| C12N 5/00 | (2006.01) |
| C12N 5/02 | (2006.01) |
| A01N 61/00 | (2006.01) |
| A61K 31/00 | (2006.01) |
| A61K 38/00 | (2006.01) |
| C07H 5/04 | (2006.01) |
| C07H 5/06 | (2006.01) |
| C07H 19/00 | (2006.01) |

(52) U.S. Cl. ............... 530/350; 435/320.1; 435/325; 514/1; 514/1.1; 514/19.2; 514/19.3; 514/21.2; 536/1; 536/18.7; 536/22.1; 536/23.1; 536/23.5

(58) Field of Classification Search .............. None
See application file for complete search history.

(56) References Cited

U.S. PATENT DOCUMENTS

| | | | |
|---|---|---|---|
| 6,218,526 B1 | 4/2001 | Swimmer et al. | |
| 7,358,351 B2 * | 4/2008 | St. Croix et al. | 536/23.1 |
| 2003/0017157 A1 * | 1/2003 | St. Croix et al. | 424/155.1 |
| 2003/0207347 A1 * | 11/2003 | Olson et al. | 435/69.1 |
| 2006/0073182 A1 * | 4/2006 | Wong et al. | 424/426 |

FOREIGN PATENT DOCUMENTS

| | | |
|---|---|---|
| WO | 01/54723 | 8/2001 |
| WO | 01/64837 | 9/2001 |

OTHER PUBLICATIONS

Koch M et al "A Novel Member of the Netrin Family, Beta-Netrin, Shares Homology With the Beta Chain of Laminin: Identification, Expression, and Functional Characterization" The Journal of Cell Biology, Rockefeller University Press, US vol. 151, No. 2, Oct. 16, 2000, pp. 221-234, XP002944911.

* cited by examiner

Primary Examiner — Alana M Harris
(74) Attorney, Agent, or Firm — Young & Thompson

(57) ABSTRACT

Described is use of a netrin selected among netrin-4, mutated netrin-4, netrin-1, netrin G1 or netrin-3, or one of their fragments or a nucleotide sequence encoding one of the netrins or one of the fragments, or an anti-idiotypic antibody of one of the netrins or of one of the fragments, or of a Fab fragment of the anti-idiotypic antibodies, for preparing a medicine for preventing or treating tumoral or non-tumoral pathologies.

7 Claims, 12 Drawing Sheets

MUTATED NETRIN-4, FRAGMENTS THEREOF AND THEIR USE AS MEDICINES

Figure 1:
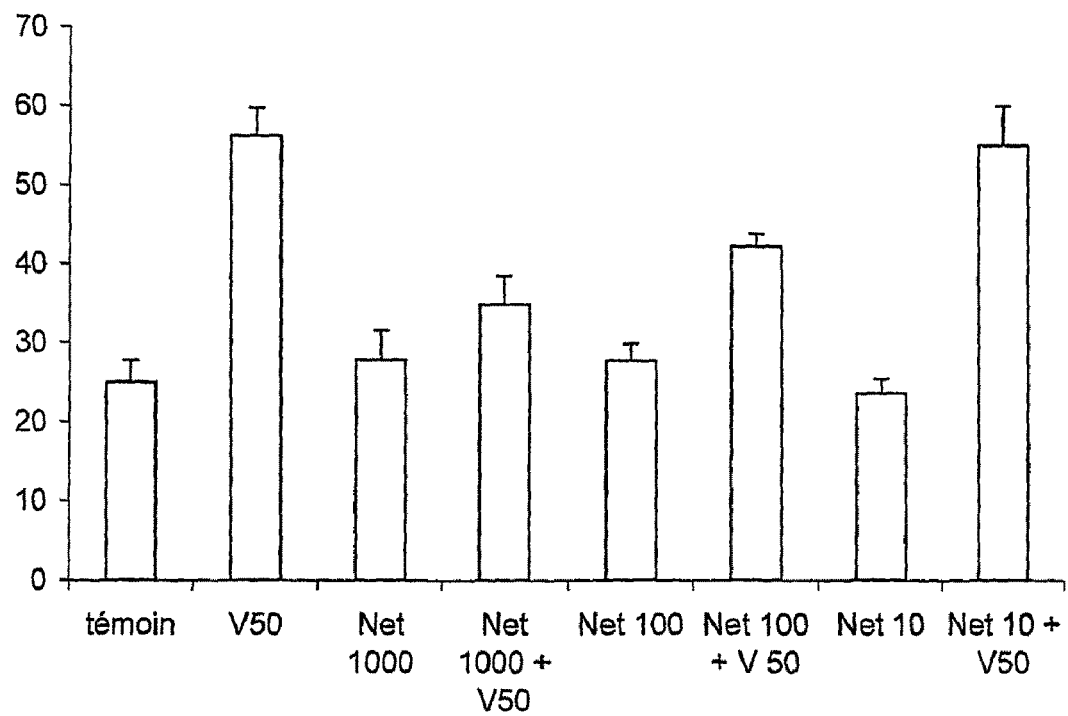

This application claims priority from PCT/FR2005/002898, filed Nov. 22, 2005, and French applications 0412362 and 0412364, both filed Nov. 22, 2004, which are herein incorporated by reference.

SEQUENCE LISTING

The instant application contains a "lengthy" Sequence Listing which has been submitted via CD-R in lieu of a printed paper copy, and is hereby incorporated by reference in its entirety. Said CD-R, recorded on Dec. 14, 2007, are labeled CRF, "Copy 1" and "Copy 2", respectively, and each contains one identical 2.01 Mb file (05081191.txt).

A subject of the present invention is mutated netrin 4, its fragments and their use as medicaments.

A subject of the present invention is also novel therapeutic uses of non-mutated netrin 4 and its fragments.

A subject of the present invention is also novel uses of neogenin ligands, such as netrins, namely netrin 1, netrin 3, netrin G1 or netrin 4, and RGM ("repulsive guidance molecule"), in combination with a chemotherapy agent, in particular within the context of the preparation of a medicament intended for the treatment of cancer.

A subject of the present invention is also novel uses of netrins, in particular netrin 1, netrin G1, netrin 3 and netrin 4, in particular within the context of the treatment of non-tumoral pathologies linked to a rarefaction of the pericytes.

Netrin 4 belongs to the family of netrins which are axon guidance molecules. At present, 4 members of this family are known (netrins 1, G, 3, 4). Netrin 4 is a protein constituted by a C-terminal basic domain interacting with heparin, 3 EGF-type domains and a laminin-type domain (Yurchenko et al., 2004).

Netrin 1 stimulates attraction when it is bound to the dcc receptor (or to neogenin) and repulsion when it is bound to the dcc receptors and one of the receptors of the UNC5H family (Livesey, 1999; Mehlen et al., 2003; Cooper et al., 1999). Moreover, netrin 1 can bind to the A2 receptor and modify the cAMP cell level, the attraction or the repulsion also being controlled by the cAMP/cGMP level (Corset et al., 2000).

Netrin G represents a family of genes differing from the other netrins by the presence of a hydrophopic C-terminal domain binding to glycosyl phosphoinositolphosphate (Nakashiba et al., 2000). Their function is still unknown. On the other hand, it has been reported that netrin G binds neither to dcc nor to UNC5H1, H2, H3 (Nakashiba et al., 2002).

Netrin 3 stimulates the attraction of the neurones when it is bound to a dcc receptor or neogenin and induces their repulsion when it is bound to a receptor of the UNC5H family of receptors (Livesey et al., 1999).

The RGM ("repulsive guidance molecule") molecules are molecules involved in the neuron axon guidance. Three genes thereof exist, known as RGM-A, RGM-B, RGM-C. It has recently become known that RGM-A is a neogenin ligand (Matsunaga et al., 2004) and that a variant of the RGM-C gene is the iron transport gene known as HFE (Papanicolaou et al., 2004).

The document US 2003/0207347A1, published on 6 Nov. 2003, describes native netrin 4 and its uses. More particularly, this Application describes a polypeptide derived from netrin 4 having angiogenesis-modulation properties, as well as the use of netrin 4 in a vascular development modulation process, in particular of angiogenesis, and more particularly of angiogenesis inhibition, in particular within the context of tumors.

At present, nothing is known about the receptors of netrin 4 nor about its possible neuronal functions.

It has recently been published that netrin 1 and netrin 4 inhibit the activity of the endothelial cells by means of the receptor UNC5H2 (Lu et al., 2004) and inhibit the vascularization of the retina.

The purpose of the present invention is also to provide novel anti-angiogenic agents.

The purpose of the present invention is to provide a combination treatment making it possible to increase the effectiveness of treatments involving angiogenesis and in particular of conventional anti-tumor treatments, or anti-angiogenic treatments used in pathologies other than tumors.

At present, no therapeutic agent exists which is capable of entering into synergy with the medicaments used in a standard fashion within the context of the treatment of age-related macular degeneration, or other ocular diseases involving neovascularization.

The present invention relates to a protein characterized in that it comprises or is constituted by:
the sequence SEQ ID NO: 522 or SEQ ID NO: 524, or
a fragment of said sequence SEQ ID NO: 522 or SEQ ID NO: 524, providing that this fragment exhibits anti-angiogenic activity and/or pericyte activation activity, said fragment comprising in particular approximately 40 to approximately 450 amino acids, and preferably approximately 40 to approximately 260 amino acids, and preferably approximately 40 to approximately 230 amino acids, and being in particular represented by one of the sequences SEQ ID NO: 2q, q varying from 187 to 248, or by the sequence SEQ ID NO: 526 or by the sequence SEQ ID NO: 528,
any sequence derived from one of the abovementioned sequences, in particular by substitution, suppression or addition of one or more amino acids, providing that this derived sequence exhibits anti-angiogenic activity and/ or pericyte activation activity, or
any sequence homologous to one of the abovementioned sequences, preferably having at least approximately 50% identity with the region comprised between the amino acids at position 261 and 515 of SEQ ID NO: 522, providing that this homologous sequence exhibits anti-angiogenic activity and/or pericyte activation activity.

The abovementioned protein SEQ ID NO: 522 is a novel protein corresponding to the mutated netrin 4 protein and the abovementioned protein SEQ ID NO: 524 corresponds to the protein SEQ ID NO: 522 without a signal peptide.

The sequence SEQ ID NO: 522 comprises 628 amino acids and the sequence SEQ ID NO: 524 comprises 609 amino acids and corresponds to a fragment of the sequence SEQ ID NO: 522 ranging from residue 20 to residue 628.

Mutated netrin 4, represented by the sequence SEQ ID NO: 522, corresponds to the netrin 4 protein represented by SEQ ID NO: 498 having the following 9 point mutations:
replacement of the cysteine at position 13 by an arginine,
replacement of the lysine at position 68 by a threonine,
replacement of the serine at position 183 by a proline,
replacement of the histidine at position 205 by a tyrosine,
replacement of the cysteine at position 234 by a tyrosine,
replacement of the alanine at position 331 by an asparagine,
replacement of the cysteine at position 332 by an arginine,
replacement of the asparagine at position 353 by a serine,
replacement of the asparagine at position 515 by a lysine.

The abovementioned fragments, corresponding to the protein sequences SEQ ID NO: 374 to SEQ ID NO: 496, are novel fragments corresponding to fragments of the abovementioned mutated netrin 4.

The abovementioned sequences SEQ ID NO: 2q correspond to the protein sequences SEQ ID NO: 374 to 496, i.e. to the following protein sequences: SEQ ID NO: 374, SEQ ID NO: 376, SEQ ID NO: 378, SEQ ID NO: 380, SEQ ID NO: 382, SEQ ID NO: 384, SEQ ID NO: 386, SEQ ID NO: 388, SEQ ID NO: 390, SEQ ID NO: 392, SEQ ID NO: 394, SEQ ID NO: 396, SEQ ID NO: 398, SEQ ID NO: 400, SEQ ID NO: 402, SEQ ID NO: 404, SEQ ID NO: 406, SEQ ID NO: 408, SEQ ID NO: 410, SEQ ID NO: 412, SEQ ID NO: 414, SEQ ID NO: 416, SEQ ID NO: 418, SEQ ID NO: 420, SEQ ID NO: 422, SEQ ID NO: 424, SEQ ID NO: 426, SEQ ID NO: 428, SEQ ID NO: 430, SEQ ID NO: 432, SEQ ID NO: 434, SEQ ID NO: 436, SEQ ID NO: 438, SEQ ID NO: 440, SEQ ID NO: 442, SEQ ID NO: 444, SEQ ID NO: 446, SEQ ID NO: 448, SEQ ID NO: 450, SEQ ID NO: 452, SEQ ID NO: 454, SEQ ID NO: 456, SEQ ID NO: 458, SEQ ID NO: 460, SEQ ID NO: 462, SEQ ID NO: 464, SEQ ID NO: 466, SEQ ID NO: 468, SEQ ID NO: 470, SEQ ID NO: 472, SEQ ID NO: 474, SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490, SEQ ID NO: 492, SEQ ID NO: 494 or SEQ ID NO: 496.

The sequence SEQ ID NO: 374 corresponds to a laminin-type fragment (protein of the extracellular matrix binding to certain integrins) of the mutated netrin 4 human protein, said fragment being encoded by the nucleotide sequence SEQ ID NO: 373. This fragment comprises 260 amino acids and corresponds to the mutated netrin 4 protein fragment ranging from residue 1 to residue 260 of the sequence SEQ ID NO: 522.

The sequence SEQ ID NO: 376 corresponds to an EGF-type fragment (EGF repetition factor domain) of the mutated netrin 4 human protein, said fragment being encoded by the nucleotide sequence SEQ ID NO: 375. This fragment comprises 255 amino acids and corresponds to the mutated netrin 4 protein fragment ranging from residue 261 to residue 515 of the sequence SEQ ID NO: 522.

The sequence SEQ ID NO: 378 is a fragment corresponding to the mutated netrin 4 human protein deleted from the sequence SEQ ID NO: 364, said fragment being encoded by the nucleotide sequence SEQ ID NO: 377. This fragment comprises 515 amino acids and corresponds to the mutated netrin 4 protein fragment ranging from residue 1 to residue 515 of the sequence SEQ ID NO: 522.

The sequence SEQ ID NO: 386 is a laminin-type fragment of the mutated netrin 4 human protein, said fragment being encoded by the nucleotide sequence SEQ ID NO: 385. This fragment comprises 229 amino acids and corresponds to the mutated netrin 4 protein fragment ranging from residue 32 to residue 260 of the sequence SEQ ID NO: 522.

The sequence SEQ ID NO: 384 is an EGF-type fragment of the mutated netrin 4 human protein, said fragment being encoded by the nucleotide sequence SEQ ID NO: 383. This fragment comprises 56 amino acids and corresponds to the mutated netrin 4 protein fragment ranging from residue 332 to residue 387 of the sequence SEQ ID NO: 522.

The mutated netrin 4 protein fragments corresponding to the protein sequences SEQ ID NO: 380 to SEQ ID NO: 496, as well as the corresponding nucleotide sequences SEQ ID NO: 379 to SEQ ID NO: 495 are shown in the following table:

| Protein sequence | Nucleotide sequence | Positions of the fragment relative to the sequence SEQ ID NO: 522 |
|---|---|---|
| SEQ ID NO: 380 | SEQ ID NO: 379 | 32-515 |
| SEQ ID NO: 382 | SEQ ID NO: 381 | 32-628 |
| SEQ ID NO: 384 | SEQ ID NO: 383 | 332-387 |
| SEQ ID NO: 386 | SEQ ID NO: 385 | 32-260 |
| SEQ ID NO: 388 | SEQ ID NO: 387 | 1-260 + 516-628 |
| SEQ ID NO: 390 | SEQ ID NO: 389 | 261-628 |
| SEQ ID NO: 392 | SEQ ID NO: 391 | 1-320 |
| SEQ ID NO: 394 | SEQ ID NO: 393 | 1-260 + 332-387 |
| SEQ ID NO: 396 | SEQ ID NO: 395 | 1-260 + 394-445 |
| SEQ ID NO: 398 | SEQ ID NO: 397 | 32-320 |
| SEQ ID NO: 400 | SEQ ID NO: 399 | 32-260 + 332-387 |
| SEQ ID NO: 402 | SEQ ID NO: 401 | 32-260 + 394-445 |
| SEQ ID NO: 404 | SEQ ID NO: 403 | 261-320 + 332-387 |
| SEQ ID NO: 406 | SEQ ID NO: 405 | 332-387 + 394-445 |
| SEQ ID NO: 408 | SEQ ID NO: 407 | 261-320 + 332-387 + 394-445 |
| SEQ ID NO: 410 | SEQ ID NO: 409 | 1-320 + 332-387 |
| SEQ ID NO: 412 | SEQ ID NO: 411 | 1-260 + 332-387 + 394-445 |
| SEQ ID NO: 414 | SEQ ID NO: 413 | 1-320 + 394-445 |
| SEQ ID NO: 416 | SEQ ID NO: 415 | 32-320 + 332-387 |
| SEQ ID NO: 418 | SEQ ID NO: 417 | 32-260 + 332-387 + 394-445 |
| SEQ ID NO: 420 | SEQ ID NO: 419 | 32-320 + 394-445 |
| SEQ ID NO: 422 | SEQ ID NO: 421 | 1-320 + 332-387 + 394-445 |
| SEQ ID NO: 424 | SEQ ID NO: 423 | 32-320 + 332-387 + 394-445 |
| SEQ ID NO: 426 | SEQ ID NO: 425 | 332-387 + 516-628 |
| SEQ ID NO: 428 | SEQ ID NO: 427 | 32-260 + 516-628 |
| SEQ ID NO: 430 | SEQ ID NO: 429 | 32-320 + 516-628 |
| SEQ ID NO: 432 | SEQ ID NO: 431 | 132-260 + 332-387 + 516-628 |
| SEQ ID NO: 434 | SEQ ID NO: 433 | 32-260 + 394-445 + 516-628 |
| SEQ ID NO: 436 | SEQ ID NO: 435 | 1-320 + 516-628 |
| SEQ ID NO: 438 | SEQ ID NO: 437 | 1-260 + 332-387 + 516-628 |
| SEQ ID NO: 440 | SEQ ID NO: 439 | 1-260 + 394-445 + 516-628 |
| SEQ ID NO: 442 | SEQ ID NO: 441 | 261-320 + 332-387 + 516-628 |
| SEQ ID NO: 444 | SEQ ID NO: 443 | 332-387 + 394-445 + 516-628 |
| SEQ ID NO: 446 | SEQ ID NO: 445 | 261-320 + 332-387 + 394-445 + 516-628 |
| SEQ ID NO: 448 | SEQ ID NO: 447 | 1-320 + 332-387 + 516-628 |
| SEQ ID NO: 450 | SEQ ID NO: 449 | 1-260 + 332-387 + 394-445 + 516-628 |
| SEQ ID NO: 452 | SEQ ID NO: 451 | 1-320 + 394-445 + 516-628 |
| SEQ ID NO: 454 | SEQ ID NO: 453 | 32-320 + 332-387 + 516-628 |
| SEQ ID NO: 456 | SEQ ID NO: 455 | 32-260 + 332-387 + 394-445 + 516-628 |
| SEQ ID NO: 458 | SEQ ID NO: 457 | 32-320 + 394-445 + 516-628 |
| SEQ ID NO: 460 | SEQ ID NO: 459 | 1-320 + 332-387 + 394-445 + 516-628 |
| SEQ ID NO: 462 | SEQ ID NO: 461 | 32-320 + 332-387 + 394-445 + 516-628 |
| SEQ ID NO: 464 | SEQ ID NO: 463 | 20-260 |
| SEQ ID NO: 466 | SEQ ID NO: 465 | 20-516 |
| SEQ ID NO: 468 | SEQ ID NO: 467 | 20-260 + 516-628 |
| SEQ ID NO: 470 | SEQ ID NO: 469 | 20-320 |
| SEQ ID NO: 472 | SEQ ID NO: 471 | 20-260 + 332-387 |
| SEQ ID NO: 474 | SEQ ID NO: 473 | 20-260 + 394-445 |
| SEQ ID NO: 476 | SEQ ID NO: 475 | 20-320 + 332-387 |
| SEQ ID NO: 478 | SEQ ID NO: 477 | 20-260 + 332-387 + 394-445 |
| SEQ ID NO: 480 | SEQ ID NO: 479 | 20-320 + 394-445 |
| SEQ ID NO: 482 | SEQ ID NO: 481 | 20-320 + 332-387 + 394-445 |
| SEQ ID NO: 484 | SEQ ID NO: 483 | 20-320 + 516-628 |
| SEQ ID NO: 486 | SEQ ID NO: 485 | 20-260 + 332-387 + 516-628 |
| SEQ ID NO: 488 | SEQ ID NO: 487 | 20-260 + 394-445 + 516-628 |
| SEQ ID NO: 490 | SEQ ID NO: 489 | 20-320 + 332-387 + 516-628 |
| SEQ ID NO: 492 | SEQ ID NO: 491 | 20-260 + 332-387 + 394-445 + 516-628 |
| SEQ ID NO: 494 | SEQ ID NO: 493 | 20-320 + 394-445 + 516-628 |
| SEQ ID NO: 496 | SEQ ID NO: 495 | 20-320 + 332-387 + 394-445 + 516-628 |

The sequence SEQ ID NO: 526 corresponds to the fragment delimited by positions 1 to 288 of SEQ ID NO: 522.

The sequence SEQ ID NO: 528 corresponds to the fragment delimited by positions 1 to 288 of SEQ ID NO: 522, fused to a peptide sequence of 24 amino acids.

The present invention relates to a protein characterized in that it comprises or is constituted by:
- the sequence SEQ ID NO: 522 or SEQ ID NO: 524, or
- a fragment of said sequence SEQ ID NO: 522 or SEQ ID NO: 524, providing that this fragment exhibits anti-angiogenic activity, said fragment comprising in particular approximately 40 to approximately 450 amino acids, and preferably approximately 40 to approximately 260 amino acids, and preferably approximately 40 to approximately 230 amino acids, and being in particular represented by one of the sequences SEQ ID NO: 2q, q varying from 187 to 248, or by the sequence SEQ ID NO: 526 or by the sequence SEQ ID NO: 528,
- any sequence derived from one of the abovementioned sequences, in particular by substitution, suppression or addition of one or more amino acids, providing that this derived sequence exhibits anti-angiogenic activity, or
- any sequence homologous to one of the abovementioned sequences, preferably having at least approximately 50% identity with the region comprised between the amino acids at position 261 and 515 of SEQ ID NO: 522, providing that this homologous sequence exhibits anti-angiogenic activity.

Angiogenesis-inhibition activity is also designated anti-angiogenic activity. This activity can be for example demonstrated in vitro by demonstrating the inhibition of the multiplication, migration and differentiation of endothelial cells by the abovementioned protein. The inhibition of the multiplication of the endothelial cells can be measured by culturing endothelial cells in the presence of the protein or of the fragment the activity of which is to be evaluated. The inhibition of the migration of the endothelial cells can be measured by making a "wound" on a lawn of endothelial cells and then incubating the cells in the presence of the fragment to be tested. The number of cells having migrated on the wound is then measured. The inhibition of the differentiation (tubulogenesis) of the endothelial cells can be measured by measuring the length of tubules formed by endothelial cells cultured on gel in the presence of the fragment to be tested.

Among the standard angiogenesis-measurement models, there can be mentioned local delivery models such as:
- sub-cutaneous injection of Matrigel (Becton Dickinson) impregnated with the compound of the invention (Inoki et al., 2002), or
- application to chicken chorioallantoid membrane of an implant containing a compound of the invention (Celerier et al., 2002).

Alternatively, the fragments of the invention can be injected by systemic route (intravenous, intraperitoneal, subcutaneous) into animals in which an experimental angiogenic disease has been created. The fragments of the invention can also be injected directly into a tumor. Alternatively the fragments or the anti-idiotypic antibodies according to the invention (described hereafter) can be delivered by a gene therapy method by local or systemic route by any method allowing the expression of the fragments or of the anti-idiotypic antibodies according to the invention. Alternatively the fragments or the anti-idiotypic antibodies according to the invention can be inserted into a plasmid which is transfected into cancer cells. All these measurement methods are in particular described in the article by Jain et al. (1997).

The term anti-tumoral activity designates an activity making it possible to inhibit tumor growth and/or induce the regression, or even the disappearance of tumors. This activity can be for example demonstrated in vivo by measuring the mass of tumors, the development of which has been induced in a mouse by injection of tumor cells, in the presence and in the absence of administration of peptide sequences of the invention and/or of nucleic acids expressing the peptide sequences of the invention.

The present invention relates to a protein characterized in that it comprises or is constituted by:
- the sequence SEQ ID NO: 522 or SEQ ID NO: 524, or
- a fragment of said sequence SEQ ID NO: 522 or SEQ ID NO: 524, providing that this fragment exhibits pericyte activation activity, said fragment comprising in particular approximately 40 to approximately 450 amino acids, and preferably approximately 40 to approximately 260 amino acids, and preferably approximately 40 to approximately 230 amino acids, and being represented in particular by one of the sequences SEQ ID NO: 2q, q varying from 187 to 248, or by the sequence SEQ ID NO: 526, or by the sequence SEQ ID NO: 528,
- any sequence derived from one of the abovementioned sequences, in particular by substitution, suppression or addition of one or more amino acids, providing that this derived sequence exhibits pericyte activation activity, or
- any sequence homologous to one of the abovementioned sequences, preferably having at least approximately 50% identity with the region comprised between the amino acids at position 261 and 515 of SEQ ID NO: 522, providing that this homologous sequence exhibits pericyte activation activity.

The pericyte activation activity is verified in particular by the proliferation and migration tests as defined hereafter and in the experimental part.

The present invention follows in particular from the demonstration by the Inventors of the function of pericyte activation by the binding of the netrins to the UNC5H4 receptors of the pericytes and of the smooth muscle cells.

The present invention also relates to a nucleotide sequence coding for a protein as defined above, namely a nucleotide sequence coding for mutated netrin 4.

A preferred nucleotide sequence according to the invention is a nucleotide sequence characterized in that it comprises or is constituted by:
- the nucleotide sequence SEQ ID NO: 521 coding for SEQ ID NO: 522, or the nucleotide sequence SEQ ID NO: 523 coding for SEQ ID NO: 524,
- a fragment of one of these nucleotide sequences, and in particular represented by one of the sequences SEQ ID NO: 2q-1, q varying from 187 to 248, or by the sequence SEQ ID NO: 525 or by the sequence SEQ ID NO: 527,
- or any nucleotide sequence derived, by degeneration of the genetic code, from one of the abovementioned nucleotide sequences, and coding for a protein represented by one of the sequences SEQ ID NO: 2q, q varying from 187 to 248, or for the sequence SEQ ID NO: 526 or for the sequence SEQ ID NO: 528,
- or any nucleotide sequence derived, in particular by substitution, suppression or addition of one or more nucleotides, from one of the abovementioned nucleotide sequences coding for a protein derived from SEQ ID NO: 2q, q varying from 187 to 248, or for the sequence SEQ ID NO: 526 or for the sequence SEQ ID NO: 528, as defined above,
- or any nucleotide sequence homologous to one of the abovementioned nucleotide sequences, preferably having of at least approximately 50% identity with one of the sequences SEQ ID NO: 2q-1 coding for a protein homologous to SEQ ID NO: 2q, or with the sequence SEQ ID NO: 525 coding for the sequence SEQ ID NO: 526 or with the sequence SEQ ID NO: 527 coding for the sequence SEQ ID NO: 528, as defined above, or any nucleotide sequence complementary to the abovementioned sequences, or any nucleotide sequence capable of hybridizing under stringent conditions with the sequence complementary to one of the abovementioned sequences.

The expression "hybridizing under stringent conditions" corresponds in particular to a hybridization buffer such as 0.5×SSC, to a hybridization temperature of 60° C., as well as to a washing medium such as 0.1×SSC with 1% SDS added and to a washing temperature of 50° C.

The abovementioned sequences SEQ ID NO: 2q-1 code for the abovementioned mutated netrin 4 fragments, represented by SEQ ID NO: 2q, and correspond to the following nucleotide sequences: SEQ ID NO: 373 coding for SEQ ID NO: 374, SEQ ID NO: 375 coding for SEQ ID NO: 376, SEQ ID NO: 377 coding for SEQ ID NO: 378, SEQ ID NO: 379 coding for SEQ ID NO: 380, SEQ ID NO: 381 coding for SEQ ID NO: 382, SEQ ID NO: 383 coding for SEQ ID NO: 384, SEQ ID NO: 385 coding for SEQ ID NO: 386, SEQ ID NO: 387 coding for SEQ ID NO: 388, SEQ ID NO: 389 coding for SEQ ID NO: 390, SEQ ID NO: 391 coding for SEQ ID NO: 392, SEQ ID NO: 393 coding for SEQ ID NO: 394, SEQ ID NO: 395 coding for SEQ ID NO: 396, SEQ ID NO: 397 coding for SEQ ID NO: 398, SEQ ID NO: 399 coding for SEQ ID NO: 400, SEQ ID NO: 401 coding for SEQ ID NO: 402, SEQ ID NO: 403 coding for SEQ ID NO: 404, SEQ ID NO: 405 coding for SEQ ID NO: 406, SEQ ID NO: 407 coding for SEQ ID NO: 408, SEQ ID NO: 409 coding for SEQ ID NO: 410, SEQ ID NO: 411 coding for SEQ ID NO: 412, SEQ ID NO: 413 coding for SEQ ID NO: 414, SEQ ID NO: 415 coding for SEQ ID NO: 416, SEQ ID NO: 417 coding for SEQ ID NO: 418, SEQ ID NO: 419 coding for SEQ ID NO: 420, SEQ ID NO: 421 coding for SEQ ID NO: 422, SEQ ID NO: 423 coding for SEQ ID NO: 424, SEQ ID NO: 425 coding for SEQ ID NO: 426, SEQ ID NO: 427 coding for SEQ ID NO: 428, SEQ ID NO: 429 coding for SEQ ID NO: 430, SEQ ID NO: 431 coding for SEQ ID NO: 432, SEQ ID NO: 433 coding for SEQ ID NO: 434, SEQ ID NO: 435 coding for SEQ ID NO: 436, SEQ ID NO: 437 coding for SEQ ID NO: 438, SEQ ID NO: 439 coding for SEQ ID NO: 440, SEQ ID NO: 441 coding for SEQ ID NO: 442, SEQ ID NO: 443 coding for SEQ ID NO: 444, SEQ ID NO: 445 coding for SEQ ID NO: 446, SEQ ID NO: 447 coding for SEQ ID NO: 448, SEQ ID NO: 449 coding for SEQ ID NO: 450, SEQ ID NO: 451 coding for SEQ ID NO: 452, SEQ ID NO: 453 coding for SEQ ID NO: 454, SEQ ID NO: 455 coding for SEQ ID NO: 456, SEQ ID NO: 457 coding for SEQ ID NO: 458, SEQ ID NO: 459 coding for SEQ ID NO: 460, SEQ ID NO: 461 coding for SEQ ID NO: 462, SEQ ID NO: 463 coding for SEQ ID NO: 464, SEQ ID NO: 465 coding for SEQ ID NO: 466, SEQ ID NO: 467 coding for SEQ ID NO: 468, SEQ ID NO: 469 coding for SEQ ID NO: 470, SEQ ID NO: 471 coding for SEQ ID NO: 472, SEQ ID NO: 473 coding for SEQ ID NO: 474, SEQ ID NO: 475 coding for SEQ ID NO: 476, SEQ ID NO: 477 coding for SEQ ID NO: 478, SEQ ID NO: 479 coding for SEQ ID NO: 480, SEQ ID NO: 481 coding for SEQ ID NO: 482, SEQ ID NO: 483 coding for SEQ ID NO: 484, SEQ ID NO: 485 coding for SEQ ID NO: 486, SEQ ID NO: 487 coding for SEQ ID NO: 488, SEQ ID NO: 489 coding for SEQ ID NO: 490, SEQ ID NO: 491 coding for SEQ ID NO: 492, SEQ ID NO: 493 coding for SEQ ID NO: 494 or SEQ ID NO: 495 coding for SEQ ID NO: 496.

The sequence SEQ ID NO: 525 codes for the sequence SEQ ID NO: 526.

The sequence SEQ ID NO: 527 codes for the sequence SEQ ID NO: 528.

The present invention also relates to a recombinant vector, in particular plasmid, cosmid, phage or virus DNA, containing a nucleotide sequence as defined above, namely a nucleotide sequence coding for mutated netrin 4 or one of its fragments as defined above, said recombinant vector being in particular characterized in that it contains the elements necessary for the expression in a host cell of the polypeptides encoded by the abovementioned nucleic acids, inserted into said vector.

The present invention also relates to a host cell, chosen in particular from bacteria, viruses, yeasts, fungi, plants or mammal cells, said host cell being transformed, in particular using a recombinant vector as defined above.

The present invention also relates to an antibody characterized in that it is directed specifically against a protein as defined above, in particular directed against mutated netrin 4 or one of its fragments as defined above.

The present invention also relates to an anti-idiotypic antibody of a protein as defined above, in particular directed against mutated netrin 4 or one of its fragments as defined above.

The present invention also relates to a Fab fragment of anti-idiotypic antibodies as defined above, in particular directed against mutated netrin 4 or one of its fragments as defined above.

The present invention also relates to a pharmaceutical composition, comprising as active ingredient,
  a protein as defined above, or
  a nucleotide sequence as defined above, or
  an antibody as defined above, or
  an anti-idiotypic antibody as defined above, or
  a Fab fragment of anti-idiotypic antibodies as defined above.

The present invention also relates to the use as defined above of the mutated netrin 4 protein, represented by the sequence SEQ ID NO: 522 or SEQ ID NO: 524, for the preparation of a medicament capable of being administered at a rate of approximately 0.1 to approximately 2000 µg/kg, in particular by intravenous route, by sub-cutaneous route, by systemic route, by intravitreal injection, by local route by means of infiltrations or by means of a collyrium, optionally combined with electropermeation.

The mutated netrin 4 protein can also be delivered by an injection of plasmid coding for the mutated netrin 4 protein of interest.

Alternatively, any one of the netrins of the invention or one of its fragments can be delivered by any intravascular device process (stents) after fixation of the protein or of the fragment to said device.

The present invention relates to the use:
  of a protein as defined above or,
  of a nucleotide sequence as defined above or,
  of an anti-idiotypic antibody as defined above,
for the preparation of a medicament intended for the prevention or treatment of pathologies requiring the inhibition of endothelial proliferation and/or migration, in particular within the context of the following pathologies: cancers and leukemias, age-related macular degeneration, choroidal neovascularization complicating myopia, neovascularization of the cornea in particular graft rejection, glaucoma, diabetic retinopathies or retinopathies of premature infants, rheumatoid polyarthritis, psoriatic polyarthritis, angiomas, angiosarcomas, Castelman's disease and Kaposi's sarcoma, or within the context of the treatment of obesity or retinal neovascularization.

The expression "inhibition of endothelial proliferation" designates any substance capable of slowing the proliferation of endothelial cells according to the proliferation test described hereafter.

The present invention relates to the combination product comprising:
  mutated netrin 4 represented by SEQ ID NO: 522 or SEQ ID NO: 524, or
  a fragment of said sequence SEQ ID NO: 522 or SEQ ID NO: 524, in particular represented by one of the sequences SEQ ID NO: 2q, q varying from 187 to 248, or by the sequence SEQ ID NO: 526 or the sequence SEQ ID NO: 528,
  in combination with an anti-angiogenic agent in particular chosen from: AVASTIN (bevacizumab) developed by Genentech and Roche, MACUGEN (pegaptanib) developed by Eyetech and Pfizer and LUCENTIS (ranibizumab) developed by Genentech and Novartis, for simultaneous or separate use or spread over time, intended for the treatment of the following pathologies: cancers and leukemias, age-related macular degeneration, choroidal neovascularization complicating myopia, neovascularization of the cornea in particular graft rejection, glaucoma, diabetic retinopathies or retinopathies of premature infants, rheumatoid polyarthritis, psoriatic polyarthritis, angiomas, angiosarcomas, Castelman's disease and Kaposi's sarcoma, or within the context of the treatment of obesity or retinal neovascularization.

Within the framework of the present invention, the doses of mutated netrin 4 comprise approximately 10 to approximately 10,000 ng/injection, preferentially approximately 100 to approximately 5,000 ng/injection, every 6 weeks.

Within the framework of the present invention, the doses of anti-angiogenic agent (AVASTIN, MACUGEN or LUCENTIS for example) comprise approximately 0.3 and 1 mg every 6 weeks.

A subject of the invention is the use:
  of an antibody as defined above, or
  of a Fab fragment of anti-idiotypic antibodies as defined above,
  for the preparation of a medicament intended for the prevention or treatment of pathologies requiring the stimulation of endothelial proliferation and/or migration, in particular within the context of the following pathologies: ischemic pathologies such as arteritis of the lower limbs, myocardial infarction, cerebral vascular accidents, sclerodermia or Raynaud's disease.

The activation of the proliferation of the endothelial cells can be measured by placing the endothelial cells in an appropriate culture medium and then measuring the total number of cells.

The activation of the migration of the endothelial cells can be measured by making a "wound" on a lawn of cells and then incubating the cells in the presence of the protein, or of the nucleotide sequence or of the anti-idiotypic antibody to be tested. Then the number of cells having migrated on the wound is measured.

The present invention relates to the use:
  of a protein as defined above
  of a nucleotide sequence as defined above, or
  of an antibody as defined above, or
  of an anti-idiotypic antibody as defined above, or
  of a Fab fragment of anti-idiotypic antibodies as defined above,
  for the preparation of a medicament intended for the prevention or treatment of the non-tumoral pathologies linked to, or caused by, a rarefaction of the pericytes or the smooth muscle cells.

The present invention relates to the use:
  of a protein as defined above
  of a nucleotide sequence as defined above, or
  of an anti-idiotypic antibody as defined above, or
  for the preparation of a medicament intended for the prevention or treatment of tumoral pathologies linked to, or caused by, a rarefaction of the pericytes or the smooth muscle cells.

The use according to the present invention is characterized in that the non-tumoral pathologies linked to, or caused by, a rarefaction of the pericytes or the smooth muscle cells, and requiring activation of the proliferation or of the migration of the pericytes or the smooth muscle cells, are chosen from:
  age-related macular degeneration,
  choroidal neovascularization complicating myopia,
  diabetic retinopathies or retinopathies of premature infants,
  neovascular glaucoma (of the cornea, of the retina etc.)
  corneal neovascularizations in particular graft rejection
  rheumatoid polyarthritis,
  psoriasis, in particular psoriatic polyarthritis,
  angiomas,
  atherosclerosis,
  obesity,
  intestinal malformations,
  Crohn's disease,
  vascular, sub-cortical vascular dementia of which Cadasil is an example,
  Alzheimer's disease,
  degenerative bone pathologies and fractures, and
  aneurysms and vascular dissections.

According to an advantageous embodiment, the use according to the present invention is characterized in that the non-tumoral pathologies linked to, or caused by, a rarefaction of the pericytes or the smooth muscle cells, and requiring activation of the proliferation or of the migration of the pericytes or the smooth muscle cells, are chosen from:
  diabetic retinopathies,
  intestinal malformations,
  Crohn's disease,
  atherosclerosis,
  obesity,
  vascular dementia, such as Alzheimer's disease,
  degenerative bone pathologies and fractures, and
  aneurysms and vascular dissections.

The present invention also relates to the use as defined above, characterized in that the activity of activation of the proliferation or of the migration of the pericytes or the smooth muscle cells is measured according to the proliferation or migration test, and in that this activation activity corresponds to at least 120% of the cells obtained in the absence of the protein, or of the nucleotide sequence or of the anti-idiotypic antibodies as defined above.

This property can be used in order to expand smooth muscle cells or pericytes from any sample of progenitor cells or stem cells in order to carry out cell therapies.

The activation of the migration of the pericytes or the smooth muscle cells can be measured by making a "wound" on a lawn of cells and then incubating the cells in the presence of the protein, or of the nucleotide sequence or of the anti-idiotypic antibody to be tested. The number of cells having migrated on the wound is then measured.

The activation of the proliferation of the pericytes or the smooth muscle cells can be measured by placing the pericytes or smooth muscle cells in an appropriate culture medium, in particular in DMEM medium containing no serum, and then measuring the number total of cells.

The present invention relates to the use:
- of mutated netrin 4 represented by SEQ ID NO: 522 or SEQ ID NO: 524, or
- of a fragment of said sequence SEQ ID NO: 522 or SEQ ID NO: 524, in particular represented by one of the sequences SEQ ID NO: 2q, q varying from 187 to 248, or by the sequence SEQ ID NO: 526 or by the sequence SEQ ID NO: 528, in combination with a chemotherapy agent, for the preparation of a medicament intended for the treatment of cancer.

The present invention relates to the combination product:
- of mutated netrin 4 represented by SEQ ID NO: 522 or SEQ ID NO: 524, or
- of a fragment of said sequence SEQ ID NO: 522 or SEQ ID NO: 524, in particular represented by one of the sequences SEQ ID NO: 2q, q varying from 187 to 248, or by the sequence SEQ ID NO: 526 or by the sequence SEQ ID NO: 528, in combination with a chemotherapy agent, for simultaneous or separate use or spread over time, intended for the treatment of tumoral pathologies.

The present invention relates to the combination product comprising:
- mutated netrin 4 represented by SEQ ID NO: 522 or SEQ ID NO: 524, or
- a fragment of said sequence SEQ ID NO: 522 or SEQ ID NO: 524, in particular represented by one of the sequences SEQ ID NO: 2q, q varying from 187 to 248, or by the sequence SEQ ID NO: 526 or by the sequence SEQ ID NO: 528, in combination with an anti-angiogenic agent in particular chosen from: AVASTIN (bevacizumab) developed by Genentech and Roche, MACUGEN (pegaptanib) developed by Eyetech and Pfizer and LUCENTIS (ranibizumab) developed by Genentech and Novartis, or any other anti-VEGF agent for simultaneous or separate use or spread over time, intended for the treatment or prevention of tumoral or non-tumoral pathologies as defined above.

The present invention relates to the use:
- of mutated netrin 4 represented by SEQ ID NO: 522 or SEQ ID NO: 524, or
- of a fragment of said sequence SEQ ID NO: 522 or SEQ ID NO: 524, in particular represented by one of the sequences SEQ ID NO: 2q, q varying from 187 to 248, or by the sequence SEQ ID NO: 526 or by the sequence SEQ ID NO: 528, in combination with an anti-angiogenic agent in particular chosen from: AVASTIN (bevacizumab) developed by Genentech and Roche, MACUGEN (pegaptanib) developed by Eyetech and Pfizer and LUCENTIS (ranibizumab) developed by Genentech and Novartis, or any other anti-VEGF agent for the preparation of a medicament intended for the prevention or treatment of tumoral or non-tumoral pathologies as defined above.

The present invention also relates to the combined use of an anti-angiogenic agent and of a chemotherapy agent.

In particular, the present invention relates to the use of a neogenin ligand, or if appropriate of a nucleotide sequence coding for a neogenin ligand, or of a vector containing a nucleotide sequence coding for said ligand, or of a host cell transformed by said vector, or of an anti-idiotypic antibody directed against said ligand, in combination with a chemotherapy agent, for the preparation of a medicament intended for the treatment of cancer.

The combination of an anti-angiogenic agent, chosen from said neogenin ligand or said nucleotide sequence or said vector or said host cell or said anti-idiotypic antibody, with a chemotherapy agent makes it possible to obtain a synergistic effect and to induce less resistance to conventional anti-tumor treatments.

Among the preferred chemotherapy agents according to the invention, there can in particular be mentioned doxorubicin, methotrexate, vinblastine, vincristine, cladribine, fluorouracil, cytarabine, anthracyclines, cisplatin, cyclophosphamide, fludarabine, gemcitabine, aromatase inhibitors, irinotecan, navelbine, oxaliplatin, taxofene, taxol and taxotere.

According to an advantageous embodiment, the use according to the invention is characterized in that the ligand or the nucleotide sequence or the anti-idiotypic antibody is chosen from:
- one of the following proteins: netrin 1 represented by SEQ ID NO: 502 or SEQ ID NO: 504, netrin G1 represented by SEQ ID NO: 506 or SEQ ID NO: 508, netrin 3 represented by SEQ ID NO: 510, netrin 4 represented by SEQ ID NO: 498 or SEQ ID NO: 500, one of the RGM molecules represented by SEQ ID NO: 512, SEQ ID NO: 514, SEQ ID NO: 516, SEQ ID NO: 518 or SEQ ID NO: 520, or mutated netrin 4 represented by SEQ ID NO: 522 or SEQ ID NO: 524,
- or a fragment of one of these proteins, in particular represented by one of the sequences SEQ ID NO: 2n, n varying from 1 to 248,
- or a nucleotide sequence coding for one of the abovementioned proteins, in particular represented by one of the following nucleotide sequences: SEQ ID NO: 501, SEQ ID NO: 503, SEQ ID NO: 505, SEQ ID NO: 507, SEQ ID NO: 509, SEQ ID NO: 497, SEQ ID NO: 499, SEQ ID NO: 511, SEQ ID NO: 513, SEQ ID NO: 515, SEQ ID NO: 517, SEQ ID NO: 519, SEQ ID NO: 521, SEQ ID NO: 523, or one of the sequences SEQ ID NO: 2n-1, n varying from 1 to 248,
- or an anti-idiotypic antibody of one of the proteins as defined above.

The abovementioned sequences SEQ ID NO: 2n correspond to the protein sequences SEQ ID NO: 2 to SEQ ID NO: 496.

The abovementioned sequences SEQ ID NO: 2n correspond to the following protein sequences: SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294, SEQ ID NO: 296, SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350, SEQ ID NO: 352, SEQ ID NO: 354, SEQ ID NO: 356, SEQ ID NO: 358, SEQ ID NO: 360, SEQ ID NO: 362, SEQ ID NO: 364, SEQ ID NO: 366, SEQ ID NO: 368, SEQ ID NO: 370, SEQ ID NO: 372, SEQ ID NO: 374, SEQ ID NO: 376, SEQ ID NO: 378, SEQ ID NO: 380, SEQ ID NO: 382, SEQ ID NO: 384, SEQ ID NO: 386, SEQ ID NO: 388, SEQ ID NO: 390, SEQ ID NO: 392, SEQ ID NO: 394, SEQ ID NO: 396, SEQ ID NO: 398, SEQ ID NO: 400, SEQ ID NO: 402, SEQ ID NO: 404, SEQ ID NO: 406, SEQ ID NO: 408, SEQ ID NO: 410, SEQ ID NO: 412, SEQ ID NO: 414, SEQ ID NO: 416, SEQ ID NO: 418, SEQ ID NO: 420, SEQ ID NO: 422, SEQ ID NO: 424, SEQ ID NO: 426, SEQ ID NO: 428, SEQ ID NO: 430, SEQ ID NO: 432, SEQ ID NO: 434, SEQ ID NO: 436, SEQ ID NO: 438, SEQ ID NO: 440, SEQ ID NO: 442, SEQ ID NO: 444, SEQ ID NO: 446, SEQ ID NO: 448, SEQ ID NO: 450, SEQ ID NO: 452, SEQ ID NO: 454, SEQ ID NO: 456, SEQ ID NO: 458, SEQ ID NO: 460, SEQ ID NO: 462, SEQ ID NO: 464, SEQ ID NO: 466, SEQ ID NO: 468, SEQ ID NO: 470, SEQ ID NO: 472, SEQ ID NO: 474, SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490, SEQ ID NO: 492, SEQ ID NO: 494 or SEQ ID NO: 496.

The abovementioned sequences SEQ ID NO: 2n-1 correspond to the nucleotide sequences SEQ ID NO: 1 to SEQ ID NO: 495.

The abovementioned sequences SEQ ID NO: 2n-1 code for the abovementioned protein sequences SEQ ID NO: 2n, and correspond to the following nucleotide sequences: SEQ ID NO: 1 coding for SEQ ID NO: 2, SEQ ID NO: 3 coding for SEQ ID NO: 4, SEQ ID NO: 5 coding for SEQ ID NO: 6, SEQ ID NO: 7 coding for SEQ ID NO: 8, SEQ ID NO: 9 coding for SEQ ID NO: 10, SEQ ID NO: 11 coding for SEQ ID NO: 12, SEQ ID NO: 13 coding for SEQ ID NO: 14, SEQ ID NO: 15 coding for SEQ ID NO: 16, SEQ ID NO: 17 coding for SEQ ID NO: 18, SEQ ID NO: 19 coding for SEQ ID NO: 20, SEQ ID NO: 21 coding for SEQ ID NO: 22, SEQ ID NO: 23 coding for SEQ ID NO: 24, SEQ ID NO: 25 coding for SEQ ID NO: 26, SEQ ID NO: 27 coding for SEQ ID NO: 28, SEQ ID NO: 29 coding for SEQ ID NO: 30, SEQ ID NO: 31 coding for SEQ ID NO: 32, SEQ ID NO: 33 coding for SEQ ID NO: 34, SEQ ID NO: 35 coding for SEQ ID NO: 36, SEQ ID NO: 37 coding for SEQ ID NO: 38, SEQ ID NO: 39 coding for SEQ ID NO: 40, SEQ ID NO: 41 coding for SEQ ID NO: 42, SEQ ID NO: 43 coding for SEQ ID NO: 44, SEQ ID NO: 45 coding for SEQ ID NO: 46, SEQ ID NO: 47 coding for SEQ ID NO: 48, SEQ ID NO: 49 coding for SEQ ID NO: 50, SEQ ID NO: 51 coding for SEQ ID NO: 52, SEQ ID NO: 53 coding for SEQ ID NO: 54, SEQ ID NO: 55 coding for SEQ ID NO: 56, SEQ ID NO: 57 coding for SEQ ID NO: 58, SEQ ID NO: 59 coding for SEQ ID NO: 60, SEQ ID NO: 61 coding for SEQ ID NO: 62, SEQ ID NO: 63 coding for SEQ ID NO: 64, SEQ ID NO: 65 coding for SEQ ID NO: 66, SEQ ID NO: 67 coding for SEQ ID NO: 68, SEQ ID NO: 69 coding for SEQ ID NO: 70, SEQ ID NO: 71 coding for SEQ ID NO: 72, SEQ ID NO: 73 coding for SEQ ID NO: 74, SEQ ID NO: 75 coding for SEQ ID NO: 76, SEQ ID NO: 77 coding for SEQ ID NO: 78, SEQ ID NO: 79 coding for SEQ ID NO: 80, SEQ ID NO: 81 coding for SEQ ID NO: 82, SEQ ID NO: 83 coding for SEQ ID NO: 84, SEQ ID NO: 85 coding for SEQ ID NO: 86, SEQ ID NO: 87 coding for SEQ ID NO: 88, SEQ ID NO: 89 coding for SEQ ID NO: 90, SEQ ID NO: 91 coding for SEQ ID NO: 92, SEQ ID NO: 93 coding for SEQ ID NO: 94, SEQ ID NO: 95 coding for SEQ ID NO: 96, SEQ ID NO: 97 coding for SEQ ID NO: 98, SEQ ID NO: 99 coding for SEQ ID NO: 100, SEQ ID NO: 101 coding for SEQ ID NO: 102, SEQ ID NO: 103 coding for SEQ ID NO: 104, SEQ ID NO: 105 coding for SEQ ID NO: 106, SEQ ID NO: 107 coding for SEQ ID NO: 108, SEQ ID NO: 109 coding for SEQ ID NO: 110, SEQ ID NO: 111 coding for SEQ ID NO: 112, SEQ ID NO: 113 coding for SEQ ID NO: 114, SEQ ID NO: 115 coding for SEQ ID NO: 116, SEQ ID NO: 117 coding for SEQ ID NO: 118, SEQ ID NO: 119 coding for SEQ ID NO: 120, SEQ ID NO: 121 coding for SEQ ID NO: 122, SEQ ID NO: 123 coding for SEQ ID NO: 124, SEQ ID NO: 125 coding for SEQ ID NO: 126, SEQ ID NO: 127 coding for SEQ ID NO: 128, SEQ ID NO: 129 coding for SEQ ID NO: 130, SEQ ID NO: 131 coding for SEQ ID NO: 132, SEQ ID NO: 133 coding for SEQ ID NO: 134, SEQ ID NO: 135 coding for SEQ ID NO: 136, SEQ ID NO: 137 coding for SEQ ID NO: 138, SEQ ID NO: 139 coding for SEQ ID NO: 140, SEQ ID NO: 141 coding for SEQ ID NO: 142, SEQ ID NO: 143 coding for SEQ ID NO: 144, SEQ ID NO: 145 coding for SEQ ID NO: 146, SEQ ID NO: 147 coding for SEQ ID NO: 148, SEQ ID NO: 149 coding for SEQ ID NO: 150, SEQ ID NO: 151 coding for SEQ ID NO: 152, SEQ ID NO: 153 coding for SEQ ID NO: 154, SEQ ID NO: 155 coding for SEQ ID NO: 156, SEQ ID NO: 157 coding for SEQ ID NO: 158, SEQ ID NO: 159 coding for SEQ ID NO: 160, SEQ ID NO: 161 coding for SEQ ID NO: 162, SEQ ID NO: 163 coding for SEQ ID NO: 164, SEQ ID NO: 165 coding for SEQ ID NO: 166, SEQ ID NO: 167 coding for SEQ ID NO: 168, SEQ ID NO: 169 coding for SEQ ID NO: 170, SEQ ID NO: 171 coding for SEQ ID NO: 172, SEQ ID NO: 173 coding for SEQ ID NO: 174, SEQ ID NO: 175 coding for SEQ ID NO: 176, SEQ ID NO: 177 coding for SEQ ID NO: 178, SEQ ID NO: 179 coding for SEQ ID NO: 180, SEQ ID NO: 181 coding for SEQ ID NO: 182, SEQ ID NO: 183 coding for SEQ ID NO: 184, SEQ ID NO: 185 coding for SEQ ID NO: 186, SEQ ID NO: 187 coding for SEQ ID NO: 188, SEQ ID NO: 189 coding for SEQ ID NO: 190, SEQ ID NO: 191 coding for SEQ ID NO: 192, SEQ ID NO: 193 coding for SEQ ID NO: 194, SEQ ID NO: 195 coding for SEQ ID NO: 196, SEQ ID NO: 197 coding for SEQ ID NO: 198, SEQ ID NO: 199 coding for SEQ ID NO: 200, SEQ ID NO: 201 coding for SEQ ID NO: 202, SEQ ID NO: 203 coding for SEQ ID NO: 204, SEQ ID NO: 205 coding for SEQ ID NO: 206, SEQ ID NO: 207 coding for SEQ ID NO:

208, SEQ ID NO: 209 coding for SEQ ID NO: 210, SEQ ID NO: 211 coding for SEQ ID NO: 212, SEQ ID NO: 213 coding for SEQ ID NO: 214, SEQ ID NO: 215 coding for SEQ ID NO: 216, SEQ ID NO: 217 coding for SEQ ID NO: 218, SEQ ID NO: 219 coding for SEQ ID NO: 220, SEQ ID NO: 221 coding for SEQ ID NO: 222, SEQ ID NO: 223 coding for SEQ ID NO: 224, SEQ ID NO: 225 coding for SEQ ID NO: 226, SEQ ID NO: 227 coding for SEQ ID NO: 228, SEQ ID NO: 229 coding for SEQ ID NO: 230, SEQ ID NO: 231 coding for SEQ ID NO: 232, SEQ ID NO: 233 coding for SEQ ID NO: 234, SEQ ID NO: 235 coding for SEQ ID NO: 236, SEQ ID NO: 237 coding for SEQ ID NO: 238, SEQ ID NO: 239 coding for SEQ ID NO: 240, SEQ ID NO: 241 coding for SEQ ID NO: 242, SEQ ID NO: 243 coding for SEQ ID NO: 244, SEQ ID NO: 245 coding for SEQ ID NO: 246, SEQ ID NO: 247 coding for SEQ ID NO: 248, SEQ ID NO: 249 coding for SEQ ID NO: 250, SEQ ID NO: 251 coding for SEQ ID NO: 252, SEQ ID NO: 253 coding for SEQ ID NO: 254, SEQ ID NO: 255 coding for SEQ ID NO: 256, SEQ ID NO: 257 coding for SEQ ID NO: 258, SEQ ID NO: 259 coding for SEQ ID NO: 260, SEQ ID NO: 261 coding for SEQ ID NO: 262, SEQ ID NO: 263 coding for SEQ ID NO: 264, SEQ ID NO: 265 coding for SEQ ID NO: 266, SEQ ID NO: 267 coding for SEQ ID NO: 268, SEQ ID NO: 269 coding for SEQ ID NO: 270, SEQ ID NO: 271 coding for SEQ ID NO: 272, SEQ ID NO: 273 coding for SEQ ID NO: 274, SEQ ID NO: 275 coding for SEQ ID NO: 276, SEQ ID NO: 277 coding for SEQ ID NO: 278, SEQ ID NO: 279 coding for SEQ ID NO: 280, SEQ ID NO: 281 coding for SEQ ID NO: 282, SEQ ID NO: 283 coding for SEQ ID NO: 284, SEQ ID NO: 285 coding for SEQ ID NO: 286, SEQ ID NO: 287 coding for SEQ ID NO: 288, SEQ ID NO: 289 coding for SEQ ID NO: 290, SEQ ID NO: 291 coding for SEQ ID NO: 292, SEQ ID NO: 293 coding for SEQ ID NO: 294, SEQ ID NO: 295 coding for SEQ ID NO: 296, SEQ ID NO: 297 coding for SEQ ID NO: 298, SEQ ID NO: 299 coding for SEQ ID NO: 300, SEQ ID NO: 301 coding for SEQ ID NO: 302, SEQ ID NO: 303 coding for SEQ ID NO: 304, SEQ ID NO: 305 coding for SEQ ID NO: 306, SEQ ID NO: 307 coding for SEQ ID NO: 308, SEQ ID NO: 309 coding for SEQ ID NO: 310, SEQ ID NO: 311 coding for SEQ ID NO: 312, SEQ ID NO: 313 coding for SEQ ID NO: 314, SEQ ID NO: 315 coding for SEQ ID NO: 316, SEQ ID NO: 317 coding for SEQ ID NO: 318, SEQ ID NO: 319 coding for SEQ ID NO: 320, SEQ ID NO: 321 coding for SEQ ID NO: 322, SEQ ID NO: 323 coding for SEQ ID NO: 324, SEQ ID NO: 325 coding for SEQ ID NO: 326, SEQ ID NO: 327 coding for SEQ ID NO: 328, SEQ ID NO: 329 coding for SEQ ID NO: 330, SEQ ID NO: 331 coding for SEQ ID NO: 332, SEQ ID NO: 333 coding for SEQ ID NO: 334, SEQ ID NO: 335 coding for SEQ ID NO: 336, SEQ ID NO: 337 coding for SEQ ID NO: 338, SEQ ID NO: 339 coding for SEQ ID NO: 340, SEQ ID NO: 341 coding for SEQ ID NO: 342, SEQ ID NO: 343 coding for SEQ ID NO: 344, SEQ ID NO: 345 coding for SEQ ID NO: 346, SEQ ID NO: 347 coding for SEQ ID NO: 348, SEQ ID NO: 349 coding for SEQ ID NO: 350, SEQ ID NO: 351 coding for SEQ ID NO: 352, SEQ ID NO: 353 coding for SEQ ID NO: 354, SEQ ID NO: 355 coding for SEQ ID NO: 356, SEQ ID NO: 357 coding for SEQ ID NO: 358, SEQ ID NO: 359 coding for SEQ ID NO: 360, SEQ ID NO: 361 coding for SEQ ID NO: 362, SEQ ID NO: 363 coding for SEQ ID NO: 364, SEQ ID NO: 365 coding for SEQ ID NO: 366, SEQ ID NO: 367 coding for SEQ ID NO: 368, SEQ ID NO: 369 coding for SEQ ID NO: 370, SEQ ID NO: 371 coding for SEQ ID NO: 372, SEQ ID NO: 373 coding for SEQ ID NO: 374, SEQ ID NO: 375 coding for SEQ ID NO: 376, SEQ ID NO: 377 coding for SEQ ID NO: 378, SEQ ID NO: 379 coding for SEQ ID NO: 380, SEQ ID NO: 381 coding for SEQ ID NO: 382, SEQ ID NO: 383 coding for SEQ ID NO: 384, SEQ ID NO: 385 coding for SEQ ID NO: 386, SEQ ID NO: 387 coding for SEQ ID NO: 388, SEQ ID NO: 389 coding for SEQ ID NO: 390, SEQ ID NO: 391 coding for SEQ ID NO: 392, SEQ ID NO: 393 coding for SEQ ID NO: 394, SEQ ID NO: 395 coding for SEQ ID NO: 396, SEQ ID NO: 397 coding for SEQ ID NO: 398, SEQ ID NO: 399 coding for SEQ ID NO: 400, SEQ ID NO: 401 coding for SEQ ID NO: 402, SEQ ID NO: 403 coding for SEQ ID NO: 404, SEQ ID NO: 405 coding for SEQ ID NO: 406, SEQ ID NO: 407 coding for SEQ ID NO: 408, SEQ ID NO: 409 coding for SEQ ID NO: 410, SEQ ID NO: 411 coding for SEQ ID NO: 412, SEQ ID NO: 413 coding for SEQ ID NO: 414, SEQ ID NO: 415 coding for SEQ ID NO: 416, SEQ ID NO: 417 coding for SEQ ID NO: 418, SEQ ID NO: 419 coding for SEQ ID NO: 420, SEQ ID NO: 421 coding for SEQ ID NO: 422, SEQ ID NO: 423 coding for SEQ ID NO: 424, SEQ ID NO: 425 coding for SEQ ID NO: 426, SEQ ID NO: 427 coding for SEQ ID NO: 428, SEQ ID NO: 429 coding for SEQ ID NO: 430, SEQ ID NO: 431 coding for SEQ ID NO: 432, SEQ ID NO: 433 coding for SEQ ID NO: 434, SEQ ID NO: 435 coding for SEQ ID NO: 436, SEQ ID NO: 437 coding for SEQ ID NO: 438, SEQ ID NO: 439 coding for SEQ ID NO: 440, SEQ ID NO: 441 coding for SEQ ID NO: 442, SEQ ID NO: 443 coding for SEQ ID NO: 444, SEQ ID NO: 445 coding for SEQ ID NO: 446, SEQ ID NO: 447 coding for SEQ ID NO: 448, SEQ ID NO: 449 coding for SEQ ID NO: 450, SEQ ID NO: 451 coding for SEQ ID NO: 452, SEQ ID NO: 453 coding for SEQ ID NO: 454, SEQ ID NO: 455 coding for SEQ ID NO: 456, SEQ ID NO: 457 coding for SEQ ID NO: 458, SEQ ID NO: 459 coding for SEQ ID NO: 460, SEQ ID NO: 461 coding for SEQ ID NO: 462, SEQ ID NO: 463 coding for SEQ ID NO: 464, SEQ ID NO: 465 coding for SEQ ID NO: 466, SEQ ID NO: 467 coding for SEQ ID NO: 468, SEQ ID NO: 469 coding for SEQ ID NO: 470, SEQ ID NO: 471 coding for SEQ ID NO: 472, SEQ ID NO: 473 coding for SEQ ID NO: 474, SEQ ID NO: 475 coding for SEQ ID NO: 476, SEQ ID NO: 477 coding for SEQ ID NO: 478, SEQ ID NO: 479 coding for SEQ ID NO: 480, SEQ ID NO: 481 coding for SEQ ID NO: 482, SEQ ID NO: 483 coding for SEQ ID NO: 484, SEQ ID NO: 485 coding for SEQ ID NO: 486, SEQ ID NO: 487 coding for SEQ ID NO: 488, SEQ ID NO: 489 coding for SEQ ID NO: 490, SEQ ID NO: 491 coding for SEQ ID NO: 492, SEQ ID NO: 493 coding for SEQ ID NO: 494 or SEQ ID NO: 495 coding for SEQ ID NO: 496.

The sequence SEQ ID NO: 498 corresponds to the human netrin 4 protein encoded by the nucleotide sequence SEQ ID NO: 497, and the sequence SEQ ID NO: 500 correspond to the abovementioned human netrin 4 protein without the signal peptide, encoded by the nucleotide sequence SEQ ID NO: 499. The sequence SEQ ID NO: 498 comprises 628 amino acids and the sequence SEQ ID NO: 500 comprises 609 amino acids and corresponds to a fragment of the sequence SEQ ID NO: 498 ranging from residue 20 to residue 628.

The sequence SEQ ID NO: 502 corresponds to the human netrin 1 protein encoded by the nucleotide sequence SEQ ID NO: 501, and the sequence SEQ ID NO: 504 corresponds to the abovementioned human netrin 1 protein without the signal peptide, encoded by the nucleotide sequence SEQ ID NO: 503. The sequence SEQ ID NO: 502 comprises 604 amino acids and the sequence SEQ ID NO: 504 comprises 580 amino acids and corresponds to a fragment of the sequence SEQ ID NO: 502 ranging from residue 25 to residue 604.

The sequence SEQ ID NO: 506 corresponds to the human netrin G1 protein encoded by the nucleotide sequence SEQ ID NO: 505, and the sequence SEQ ID NO: 508 corresponds to the abovementioned human netrin G1 protein without the signal peptide, encoded by the nucleotide sequence SEQ ID NO: 507. The sequence SEQ ID NO: 506 comprises 438 amino acids and the sequence SEQ ID NO: 508 comprises 410 amino acids and corresponds to a fragment of the sequence SEQ ID NO: 506 ranging from residue 29 to residue 438.

The sequence SEQ ID NO: 510 corresponds to the human netrin 3 protein encoded by the nucleotide sequence SEQ ID NO: 509. The sequence SEQ ID NO: 510 comprises 580 amino acids.

The sequence SEQ ID NO: 512 corresponds to the RGM-A molecule encoded by the nucleotide sequence SEQ ID NO: 511. The sequence SEQ ID NO: 512 comprises 450 amino acids.

The sequence SEQ ID NO: 514 corresponds to the RGM-B molecule encoded by the nucleotide sequence SEQ ID NO: 513, and the sequence SEQ ID NO: 518 corresponds to the abovementioned RGM-B molecule without the signal peptide, encoded by the nucleotide sequence SEQ ID NO: 517. The sequence SEQ ID NO: 514 comprises 437 amino acids and the sequence SEQ ID NO: 518 comprises 392 amino acids and corresponds to a fragment of the sequence SEQ ID NO: 514 ranging from residue 46 to residue 437.

The sequence SEQ ID NO: 516 corresponds to the RGM-C molecule encoded by the nucleotide sequence SEQ ID NO: 515, and the sequence SEQ ID NO: 520 corresponds to the abovementioned RGM-C molecule without the signal peptide, encoded by the nucleotide sequence SEQ ID NO: 519. The sequence SEQ ID NO: 516 comprises 426 amino acids and the sequence SEQ ID NO: 520 comprises 391 amino acids and corresponds to a fragment of the sequence SEQ ID NO: 516 ranging from residue 36 to residue 426.

The sequence SEQ ID NO: 360 corresponds to a laminin-type fragment (protein of the extracellular matrix binding to certain integrins) of the human netrin 4 protein, said fragment being encoded by the nucleotide sequence SEQ ID NO: 359. This fragment comprises 260 amino acids and corresponds to the fragment of the netrin 4 protein ranging from residue 1 to residue 260 of the sequence SEQ ID NO: 498.

The sequence SEQ ID NO: 362 corresponds to an EGF-type fragment (EGF repetition factor domain) of the human netrin 4 protein, said fragment being encoded by the nucleotide sequence SEQ ID NO: 361. This fragment comprises 255 amino acids and corresponds to the fragment of the netrin 4 protein ranging from residue 261 to residue 515 of the sequence SEQ ID NO: 498.

The sequence SEQ ID NO: 364 corresponds to the fragment binding to the heparin of the human netrin 4 protein, said fragment being encoded by the nucleotide sequence SEQ ID NO: 363. This fragment comprises 113 amino acids and corresponds to the fragment of the netrin 4 protein ranging from residue 516 to residue 628 of the sequence SEQ ID NO: 498.

The sequence SEQ ID NO: 366 is a fragment corresponding to the human netrin 4 protein deleted from the sequence SEQ ID NO: 364, said fragment being encoded by the nucleotide sequence SEQ ID NO: 365. This fragment comprises 515 amino acids and corresponds to the fragment of the netrin 4 protein ranging from residue 1 to residue 515 of the sequence SEQ ID NO: 498.

The sequence SEQ ID NO: 8 is a laminin-type fragment of the human netrin 4 protein, said fragment being encoded by the nucleotide sequence SEQ ID NO: 7. This fragment comprises 229 amino acids and corresponds to the fragment of the netrin 4 protein ranging from residue 32 to residue 260 of the sequence SEQ ID NO: 498.

The sequence SEQ ID NO: 2 is an EGF-type fragment of the human netrin 4 protein, said fragment being encoded by the nucleotide sequence SEQ ID NO: 1. This fragment comprises 60 amino acids and corresponds to the fragment of the netrin 4 protein ranging from residue 261 to residue 320 of the sequence SEQ ID NO: 498.

The sequence SEQ ID NO: 4 is an EGF-type fragment of the human netrin 4 protein, said fragment being encoded by the nucleotide sequence SEQ ID NO: 3. This fragment comprises 56 amino acids and corresponds to the fragment of the netrin 4 protein ranging from residue 332 to residue 387 of the sequence SEQ ID NO: 498.

The sequence SEQ ID NO: 6 is an EGF-type fragment of the human netrin 4 protein, said fragment being encoded by the nucleotide sequence SEQ ID NO: 5. This fragment comprises 52 amino acids and corresponds to the fragment of the netrin 4 protein ranging from residue 394 to residue 445 of the sequence SEQ ID NO: 498.

The fragments of the netrin 4 protein corresponding to the protein sequences SEQ ID NO: 10 to SEQ ID NO: 126 and to the protein sequences SEQ ID NO: 368 and SEQ ID NO: 370, as well as the corresponding nucleotide sequences SEQ ID NO: 9 to SEQ ID NO: 125 and the nucleotide sequences SEQ ID NO: 367 and SEQ ID NO: 369 are shown in the following table:

| Protein sequence | Nucleotide sequence | Positions of the fragment relative to the sequence SEQ ID NO: 498 |
| --- | --- | --- |
| SEQ ID NO: 10 | SEQ ID NO: 9 | 1-260 + 516-628 |
| SEQ ID NO: 12 | SEQ ID NO: 11 | 261-628 |
| SEQ ID NO: 14 | SEQ ID NO: 13 | 1-320 |
| SEQ ID NO: 16 | SEQ ID NO: 15 | 1-260 + 332-387 |
| SEQ ID NO: 18 | SEQ ID NO: 17 | 1-260 + 394-445 |
| SEQ ID NO: 20 | SEQ ID NO: 19 | 32-320 |
| SEQ ID NO: 22 | SEQ ID NO: 21 | 32-260 + 332-387 |
| SEQ ID NO: 24 | SEQ ID NO: 23 | 32-260 + 394-445 |
| SEQ ID NO: 26 | SEQ ID NO: 25 | 261-320 + 332-387 |
| SEQ ID NO: 28 | SEQ ID NO: 27 | 332-387 + 394-445 |
| SEQ ID NO: 30 | SEQ ID NO: 29 | 261-320 + 394-445 |
| SEQ ID NO: 32 | SEQ ID NO: 31 | 261-320 + 332-387 + 394-445 |
| SEQ ID NO: 34 | SEQ ID NO: 33 | 1-320 + 332-387 |
| SEQ ID NO: 36 | SEQ ID NO: 35 | 1-260 + 332-387 + 394-445 |
| SEQ ID NO: 38 | SEQ ID NO: 37 | 1-320 + 394-445 |
| SEQ ID NO: 40 | SEQ ID NO: 39 | 32-320 + 332-387 |
| SEQ ID NO: 42 | SEQ ID NO: 41 | 32-260 + 332-387 + 394-445 |
| SEQ ID NO: 44 | SEQ ID NO: 43 | 32-320 + 394-445 |
| SEQ ID NO: 46 | SEQ ID NO: 45 | 1-320 + 332-387 + 394-445 |
| SEQ ID NO: 48 | SEQ ID NO: 47 | 32-320 + 332-387 + 394-445 |
| SEQ ID NO: 50 | SEQ ID NO: 49 | 261-320 + 516-628 |
| SEQ ID NO: 52 | SEQ ID NO: 51 | 332-387 + 516-628 |
| SEQ ID NO: 54 | SEQ ID NO: 53 | 394-445 + 516-628 |
| SEQ ID NO: 56 | SEQ ID NO: 55 | 32-260 + 516-628 |
| SEQ ID NO: 58 | SEQ ID NO: 57 | 32-320 + 516-628 |
| SEQ ID NO: 60 | SEQ ID NO: 59 | 32-260 + 332-387 + 516-628 |
| SEQ ID NO: 62 | SEQ ID NO: 61 | 32-260 + 394-445 + 516-628 |
| SEQ ID NO: 64 | SEQ ID NO: 63 | 1-320 + 516-628 |
| SEQ ID NO: 66 | SEQ ID NO: 65 | 1-260 + 332-387 + 516-628 |
| SEQ ID NO: 68 | SEQ ID NO: 67 | 1-260 + 394-445 + 516-628 |
| SEQ ID NO: 70 | SEQ ID NO: 69 | 261-320 + 332-387 + 516-628 |
| SEQ ID NO: 72 | SEQ ID NO: 71 | 261-320 + 394-445 + 516-628 |
| SEQ ID NO: 74 | SEQ ID NO: 73 | 332-387 + 394-445 + 516-628 |
| SEQ ID NO: 76 | SEQ ID NO: 75 | 261-320 + 332-387 + 394-445 + 516-628 |
| SEQ ID NO: 78 | SEQ ID NO: 77 | 1-320 + 332-387 + 516-628 |
| SEQ ID NO: 80 | SEQ ID NO: 79 | 1-260 + 332-387 + 394-445 + 516-628 |
| SEQ ID NO: 82 | SEQ ID NO: 81 | 1-320 + 394-445 + 516-628 |
| SEQ ID NO: 84 | SEQ ID NO: 83 | 32-320 + 332-387 + 516-628 |
| SEQ ID NO: 86 | SEQ ID NO: 85 | 32-260 + 332-387 + 394-445 + |

| Protein sequence | Nucleotide sequence | Positions of the fragment relative to the sequence SEQ ID NO: 498 |
|---|---|---|
| | | 516-628 |
| SEQ ID NO: 88 | SEQ ID NO: 87 | 32-320 + 394-445 + 516-628 |
| SEQ ID NO: 90 | SEQ ID NO: 89 | 1-320 + 332-387 + 394-445 + 516-628 |
| SEQ ID NO: 92 | SEQ ID NO: 91 | 32-320 + 332-387 + 394-445 + 516-628 |
| SEQ ID NO: 94 | SEQ ID NO: 93 | 20-260 |
| SEQ ID NO: 96 | SEQ ID NO: 95 | 20-516 |
| SEQ ID NO: 98 | SEQ ID NO: 97 | 20-260 + 516-628 |
| SEQ ID NO: 100 | SEQ ID NO: 99 | 20-320 |
| SEQ ID NO: 102 | SEQ ID NO: 101 | 20-260 + 332-387 |
| SEQ ID NO: 104 | SEQ ID NO: 103 | 20-260 + 394-445 |
| SEQ ID NO: 106 | SEQ ID NO: 105 | 20-320 + 332-387 |
| SEQ ID NO: 108 | SEQ ID NO: 107 | 20-260 + 332-387 + 394-445 |
| SEQ ID NO: 110 | SEQ ID NO: 109 | 20-320 + 394-445 |
| SEQ ID NO: 112 | SEQ ID NO: 111 | 20-320 + 332-387 + 394-445 |
| SEQ ID NO: 114 | SEQ ID NO: 113 | 20-320 + 516-628 |
| SEQ ID NO: 116 | SEQ ID NO: 115 | 20-260 + 332-387 + 516-628 |
| SEQ ID NO: 118 | SEQ ID NO: 117 | 20-260 + 394-445 + 516-628 |
| SEQ ID NO: 120 | SEQ ID NO: 119 | 20-320 + 332-387 + 516-628 |
| SEQ ID NO: 122 | SEQ ID NO: 121 | 20-260 + 332-387 + 394-445 + 516-628 |
| SEQ ID NO: 124 | SEQ ID NO: 123 | 20-320 + 394-445 + 516-628 |
| SEQ ID NO: 126 | SEQ ID NO: 125 | 20-320 + 332-387 + 394-445 + 516-628 |
| SEQ ID NO: 368 | SEQ ID NO: 367 | 32-515 |
| SEQ ID NO: 370 | SEQ ID NO: 369 | 32-628 |

The sequence SEQ ID NO: 128 corresponds to a laminin-type fragment (protein of the extracellular matrix binding to certain integrins) of the human netrin 1 protein, said fragment being encoded by the nucleotide sequence SEQ ID NO: 127. This fragment comprises 283 amino acids and corresponds to the fragment of the netrin 1 protein ranging from residue 1 to residue 283 of the sequence SEQ ID NO: 502.

The sequence SEQ ID NO: 130 corresponds to an EGF-type fragment (EGF repetition factor domain) of the human netrin 1 protein, said fragment being encoded by the nucleotide sequence SEQ ID NO: 129. This fragment comprises 204 amino acids and corresponds to the fragment of the netrin 1 protein ranging from residue 284 to residue 487 of the sequence SEQ ID NO: 502.

The sequence SEQ ID NO: 132 corresponds to the fragment binding to the heparin of the human netrin 1 protein, said fragment being encoded by the nucleotide sequence SEQ ID NO: 131. This fragment comprises 117 amino acids and corresponds to the fragment of the netrin 1 protein ranging from residue 488 to residue 604 of the sequence SEQ ID NO: 502.

The sequence SEQ ID NO: 372 is a fragment corresponding to the human netrin 1 protein deleted from the sequence SEQ ID NO: 132, said fragment being encoded by the nucleotide sequence SEQ ID NO: 371. This fragment comprises 487 amino acids and corresponds to the fragment of the netrin 1 protein ranging from residue 1 to residue 487 of the sequence SEQ ID NO: 502.

The sequence SEQ ID NO: 140 is a laminin-type fragment of the human netrin 1 protein, said fragment being encoded by the nucleotide sequence SEQ ID NO: 139. This fragment comprises 235 amino acids and corresponds to the fragment of the netrin 1 protein ranging from residue 49 to residue 283 of the sequence SEQ ID NO: 502.

The sequence SEQ ID NO: 134 is an EGF-type fragment of the human netrin 1 protein, said fragment being encoded by the nucleotide sequence SEQ ID NO: 133. This fragment comprises 48 amino acids and corresponds to the fragment of the netrin 1 protein ranging from residue 284 to residue 331 of the sequence SEQ ID NO: 502.

The sequence SEQ ID NO: 136 is an EGF-type fragment of the human netrin 1 protein, said fragment being encoded by the nucleotide sequence SEQ ID NO: 135. This fragment comprises 56 amino acids and corresponds to the fragment of the netrin 1 protein ranging from residue 341 to residue 396 of the sequence SEQ ID NO: 502.

The sequence SEQ ID NO: 138 is an EGF-type fragment of the human netrin 1 protein, said fragment being encoded by the nucleotide sequence SEQ ID NO: 137. This fragment comprises 48 amino acids and corresponds to the fragment of the netrin 1 protein ranging from residue 403 to residue 450 of the sequence SEQ ID NO: 502.

The fragments of the netrin 1 protein corresponding to the protein sequences SEQ ID NO: 142 to SEQ ID NO: 262, as well as the corresponding nucleotide sequences SEQ ID NO: 141 to SEQ ID NO: 261 are shown in the following table:

| Protein sequence | Nucleotide sequence | Positions of the fragment relative to the sequence SEQ ID NO: 502 |
|---|---|---|
| SEQ ID NO: 142 | SEQ ID NO: 141 | 1-283 + 488-604 |
| SEQ ID NO: 144 | SEQ ID NO: 143 | 284-604 |
| SEQ ID NO: 146 | SEQ ID NO: 145 | 49-487 |
| SEQ ID NO: 148 | SEQ ID NO: 147 | 49-604 |
| SEQ ID NO: 150 | SEQ ID NO: 149 | 1-331 |
| SEQ ID NO: 152 | SEQ ID NO: 151 | 1-283 + 341-396 |
| SEQ ID NO: 154 | SEQ ID NO: 153 | 1-283 + 403-450 |
| SEQ ID NO: 156 | SEQ ID NO: 155 | 49-331 |
| SEQ ID NO: 158 | SEQ ID NO: 157 | 49-283 + 341-396 |
| SEQ ID NO: 160 | SEQ ID NO: 159 | 49-283 + 403-450 |
| SEQ ID NO: 162 | SEQ ID NO: 161 | 284-331 + 341-396 |
| SEQ ID NO: 164 | SEQ ID NO: 163 | 341-396 + 403-450 |
| SEQ ID NO: 166 | SEQ ID NO: 165 | 284-331 + 403-450 |
| SEQ ID NO: 168 | SEQ ID NO: 167 | 284-331 + 341-396 + 403-450 |
| SEQ ID NO: 170 | SEQ ID NO: 169 | 1-331 + 341-396 |
| SEQ ID NO: 172 | SEQ ID NO: 171 | 1-283 + 341-396 + 403-450 |
| SEQ ID NO: 174 | SEQ ID NO: 173 | 1-331 + 403-450 |
| SEQ ID NO: 176 | SEQ ID NO: 175 | 49-331 + 341-396 |
| SEQ ID NO: 178 | SEQ ID NO: 177 | 49-283 + 341-396 + 403-450 |
| SEQ ID NO: 180 | SEQ ID NO: 179 | 49-331 + 403-450 |
| SEQ ID NO: 182 | SEQ ID NO: 181 | 1-331 + 341-396 + 403-450 |
| SEQ ID NO: 184 | SEQ ID NO: 183 | 49-331 + 341-396 + 403-450 |
| SEQ ID NO: 186 | SEQ ID NO: 185 | 284-331 + 488-604 |
| SEQ ID NO: 188 | SEQ ID NO: 187 | 341-396 + 488-604 |
| SEQ ID NO: 190 | SEQ ID NO: 189 | 403-450 + 488-604 |
| SEQ ID NO: 192 | SEQ ID NO: 191 | 49-283 + 488-604 |
| SEQ ID NO: 194 | SEQ ID NO: 193 | 49-331 + 488-604 |
| SEQ ID NO: 196 | SEQ ID NO: 195 | 49-283 + 341-396 + 488-604 |
| SEQ ID NO: 198 | SEQ ID NO: 197 | 49-283 + 403-450 + 488-604 |
| SEQ ID NO: 200 | SEQ ID NO: 199 | 1-331 + 488-604 |
| SEQ ID NO: 202 | SEQ ID NO: 201 | 1-283 + 341-396 + 488-604 |
| SEQ ID NO: 204 | SEQ ID NO: 203 | 1-283 + 403-450 + 488-604 |
| SEQ ID NO: 206 | SEQ ID NO: 205 | 284-331 + 341-396 + 488-604 |
| SEQ ID NO: 208 | SEQ ID NO: 207 | 284-331 + 403-450 + 488-604 |
| SEQ ID NO: 210 | SEQ ID NO: 209 | 341-396 + 403-450 + 488-604 |
| SEQ ID NO: 212 | SEQ ID NO: 211 | 284-331 + 341-396 + 403-450 + 488-604 |
| SEQ ID NO: 214 | SEQ ID NO: 213 | 1-331 + 341-396 + 488-604 |
| SEQ ID NO: 216 | SEQ ID NO: 215 | 1-283 + 341-396 + 403-450 + 488-604 |
| SEQ ID NO: 218 | SEQ ID NO: 217 | 1-331 + 403-450 + 488-604 |
| SEQ ID NO: 220 | SEQ ID NO: 219 | 49-331 + 341-396 + 488-604 |
| SEQ ID NO: 222 | SEQ ID NO: 221 | 49-283 + 341-396 + 403-450 + 488-604 |
| SEQ ID NO: 224 | SEQ ID NO: 223 | 49-331 + 403-450 + 488-604 |
| SEQ ID NO: 226 | SEQ ID NO: 225 | 1-331 + 341-396 + 403-450 + 488-604 |
| SEQ ID NO: 228 | SEQ ID NO: 227 | 49-331 + 341-396 + 403-450 + 488-604 |
| SEQ ID NO: 230 | SEQ ID NO: 229 | 25-283 |
| SEQ ID NO: 232 | SEQ ID NO: 231 | 25-487 |
| SEQ ID NO: 234 | SEQ ID NO: 233 | 25-283 + 488-604 |
| SEQ ID NO: 236 | SEQ ID NO: 235 | 25-331 |

| Protein sequence | Nucleotide sequence | Positions of the fragment relative to the sequence SEQ ID NO: 502 |
|---|---|---|
| SEQ ID NO: 238 | SEQ ID NO: 237 | 25-283 + 341-396 |
| SEQ ID NO: 240 | SEQ ID NO: 239 | 25-283 + 403-450 |
| SEQ ID NO: 242 | SEQ ID NO: 241 | 25-331 + 341-396 |
| SEQ ID NO: 244 | SEQ ID NO: 243 | 25-283 + 341-396 + 403-450 |
| SEQ ID NO: 246 | SEQ ID NO: 245 | 25-331 + 403-450 |
| SEQ ID NO: 248 | SEQ ID NO: 247 | 25-331 + 341-396 + 403-450 |
| SEQ ID NO: 250 | SEQ ID NO: 249 | 25-331 + 488-604 |
| SEQ ID NO: 252 | SEQ ID NO: 251 | 25-283 + 341-396 + 488-604 |
| SEQ ID NO: 254 | SEQ ID NO: 253 | 25-283 + 403-450 + 488-604 |
| SEQ ID NO: 256 | SEQ ID NO: 255 | 25-331 + 341-396 + 488-604 |
| SEQ ID NO: 258 | SEQ ID NO: 257 | 25-283 + 341-396 + 403-450 + 488-604 |
| SEQ ID NO: 260 | SEQ ID NO: 259 | 25-331 + 403-450 + 488-604 |
| SEQ ID NO: 262 | SEQ ID NO: 261 | 25-331 + 341-396 + 403-450 + 488-604 |

The sequence SEQ ID NO: 264 corresponds to a laminin-type fragment (protein of the extracellular matrix binding to certain integrins) of the human netrin G1 protein, said fragment being encoded by the nucleotide sequence SEQ ID NO: 263. This fragment comprises 295 amino acids and corresponds to the fragment of the netrin G1 protein ranging from residue 1 to residue 295 of the sequence SEQ ID NO: 506.

The sequence SEQ ID NO: 266 corresponds to an EGF-type fragment (EGF repetition factor domain) of the human netrin G1 protein, said fragment being encoded by the nucleotide sequence SEQ ID NO: 265. This fragment comprises 143 amino acids and corresponds to the fragment of the netrin G1 protein ranging from residue 296 to residue 438 of the sequence SEQ ID NO: 506.

The sequence SEQ ID NO: 268 is a laminin-type fragment of the human netrin G1 protein, said fragment being encoded by the nucleotide sequence SEQ ID NO: 267. This fragment comprises 225 amino acids and corresponds to the fragment of the netrin G1 protein ranging from residue 71 to residue 295 of the sequence SEQ ID NO: 506.

The sequence SEQ ID NO: 270 is an EGF-type fragment of the human netrin G1 protein, said fragment being encoded by the nucleotide sequence SEQ ID NO: 269. This fragment comprises 47 amino acids and corresponds to the fragment of the netrin G1 protein ranging from residue 296 to residue 342 of the sequence SEQ ID NO: 506.

The sequence SEQ ID NO: 272 is an EGF-type fragment of the human netrin G1 protein, said fragment being encoded by the nucleotide sequence SEQ ID NO: 271. This fragment comprises 37 amino acids and corresponds to the fragment of the netrin G1 protein ranging from residue 373 to residue 409 of the sequence SEQ ID NO: 506.

The fragments of the netrin G1 protein corresponding to the protein sequences SEQ ID NO: 274 to SEQ ID NO: 296, as well as the corresponding nucleotide sequences SEQ ID NO: 273 to SEQ ID NO: 295, are shown in the following table:

| Protein sequence | Nucleotide sequence | Positions of the fragment relative to the sequence SEQ ID NO: 506 |
|---|---|---|
| SEQ ID NO: 274 | SEQ ID NO: 273 | 1-342 |
| SEQ ID NO: 276 | SEQ ID NO: 275 | 1-295 + 373-409 |
| SEQ ID NO: 278 | SEQ ID NO: 277 | 1-342 + 373-409 |
| SEQ ID NO: 280 | SEQ ID NO: 279 | 71-438 |
| SEQ ID NO: 282 | SEQ ID NO: 281 | 71-342 |
| SEQ ID NO: 284 | SEQ ID NO: 283 | 71-295 + 373-409 |
| SEQ ID NO: 286 | SEQ ID NO: 285 | 296-342 + 373-409 |
| SEQ ID NO: 288 | SEQ ID NO: 287 | 71-342 + 373-409 |
| SEQ ID NO: 290 | SEQ ID NO: 289 | 29-295 |
| SEQ ID NO: 292 | SEQ ID NO: 291 | 29-342 |
| SEQ ID NO: 294 | SEQ ID NO: 293 | 29-295 + 373-409 |
| SEQ ID NO: 296 | SEQ ID NO: 295 | 29-342 + 373-409 |

The sequence SEQ ID NO: 298 corresponds to a laminin-type fragment (protein of the extracellular matrix binding to certain integrins) of the human netrin 3 protein, said fragment being encoded by the nucleotide sequence SEQ ID NO: 297. This fragment comprises 253 amino acids and corresponds to the fragment of the netrin 3 protein ranging from residue 1 to residue 253 of the sequence SEQ ID NO: 510.

The sequence SEQ ID NO: 300 is a laminin-type fragment of the human netrin 3 protein, said fragment being encoded by the nucleotide sequence SEQ ID NO: 299. This fragment comprises 220 amino acids and corresponds to the fragment of the netrin 3 protein ranging from residue 34 to residue 253 of the sequence SEQ ID NO: 510.

The sequence SEQ ID NO: 302 corresponds to an EGF-type fragment (EGF repetition factor domain) of the human netrin 3 protein, said fragment being encoded by the nucleotide sequence SEQ ID NO: 301. This fragment comprises 180 amino acids and corresponds to the fragment of the netrin 3 protein ranging from residue 254 to residue 433 of the sequence SEQ ID NO: 510.

The sequence SEQ ID NO: 304 is an EGF-type fragment of the human netrin 3 protein, said fragment being encoded by the nucleotide sequence SEQ ID NO: 303. This fragment comprises 46 amino acids and corresponds to the fragment of the netrin 3 protein ranging from residue 254 to residue 299 of the sequence SEQ ID NO: 510.

The sequence SEQ ID NO: 306 is an EGF-type fragment of the human netrin 3 protein, said fragment being encoded by the nucleotide sequence SEQ ID NO: 305. This fragment comprises 50 amino acids and corresponds to the fragment of the netrin 3 protein ranging from residue 373 to residue 422 of the sequence SEQ ID NO: 510.

The sequence SEQ ID NO: 308 corresponds to the fragment binding to the heparin of the human netrin 3 protein, said fragment being encoded by the nucleotide sequence SEQ ID NO: 307. This fragment comprises 148 amino acids and corresponds to the fragment of the netrin 3 protein ranging from residue 433 to residue 580 of the sequence SEQ ID NO: 510.

The fragments of the netrin 3 protein corresponding to the protein sequences SEQ ID NO: 310 to SEQ ID NO: 352, as well as the corresponding nucleotide sequences SEQ ID NO: 309 to SEQ ID NO: 351 are shown in the following table:

| Protein sequence | Nucleotide sequence | Positions of the fragment relative to the sequence SEQ ID NO: 510 |
|---|---|---|
| SEQ ID NO: 310 | SEQ ID NO: 309 | 1-422 |
| SEQ ID NO: 312 | SEQ ID NO: 311 | 254-433 |
| SEQ ID NO: 314 | SEQ ID NO: 313 | 1-253 + 433-580 |
| SEQ ID NO: 316 | SEQ ID NO: 315 | 1-299 |
| SEQ ID NO: 318 | SEQ ID NO: 317 | 1-253 + 373-422 |
| SEQ ID NO: 320 | SEQ ID NO: 319 | 1-299 + 373-422 |
| SEQ ID NO: 322 | SEQ ID NO: 321 | 254-299 + 433-580 |
| SEQ ID NO: 324 | SEQ ID NO: 323 | 373-422 + 433-580 |
| SEQ ID NO: 326 | SEQ ID NO: 325 | 254-299 + 373-422 |
| SEQ ID NO: 328 | SEQ ID NO: 327 | 254-299 + 373-422 + 433-580 |

| Protein sequence | Nucleotide sequence | Positions of the fragment relative to the sequence SEQ ID NO: 510 |
|---|---|---|
| SEQ ID NO: 330 | SEQ ID NO: 329 | 1-299 + 433-580 |
| SEQ ID NO: 332 | SEQ ID NO: 331 | 1-253 + 373-422 + 433-580 |
| SEQ ID NO: 334 | SEQ ID NO: 333 | 1-299 + 373-422 + 433-580 |
| SEQ ID NO: 336 | SEQ ID NO: 335 | 34-433 |
| SEQ ID NO: 338 | SEQ ID NO: 337 | 34-253 + 433-580 |
| SEQ ID NO: 340 | SEQ ID NO: 339 | 34-299 |
| SEQ ID NO: 342 | SEQ ID NO: 341 | 34-253 + 373-422 |
| SEQ ID NO: 344 | SEQ ID NO: 343 | 34-580 |
| SEQ ID NO: 346 | SEQ ID NO: 345 | 34-299 + 373-422 |
| SEQ ID NO: 348 | SEQ ID NO: 347 | 34-299 + 433-580 |
| SEQ ID NO: 350 | SEQ ID NO: 349 | 34-253 + 373-422 + 433-580 |
| SEQ ID NO: 352 | SEQ ID NO: 351 | 34-299 + 373-422 + 433-580 |

The sequence SEQ ID NO: 354 corresponds to a fragment of the protein RGM-A, said fragment being encoded by the nucleotide sequence SEQ ID NO: 353. This fragment comprises 111 amino acids and corresponds to the fragment of the protein RGM-A ranging from residue 180 to residue 290 of the sequence SEQ ID NO: 512.

The sequence SEQ ID NO: 356 corresponds to a fragment of the protein RGM-B, said fragment being encoded by the nucleotide sequence SEQ ID NO: 355. This fragment comprises 111 amino acids and corresponds to the fragment of the protein RGM-B ranging from residue 180 to residue 290 of the sequence SEQ ID NO: 514.

The sequence SEQ ID NO: 358 corresponds to a fragment of the protein RGM-C, said fragment being encoded by the nucleotide sequence SEQ ID NO: 357. This fragment comprises 111 amino acids and corresponds to the fragment of the protein RGM-C ranging from residue 180 to residue 290 of the sequence SEQ ID NO: 516.

The present invention also relates to a combination product comprising at least one neogenin ligand, or if appropriate a nucleotide sequence coding for a neogenin ligand, in particular chosen from:
- one of the following proteins: netrin 1 represented by SEQ ID NO: 502 or SEQ ID NO: 504, netrin G1 represented by SEQ ID NO: 506 or SEQ ID NO: 508, netrin 3 represented by SEQ ID NO: 510, netrin 4 represented by SEQ ID NO: 498 or SEQ ID NO: 500, one of the RGM molecules represented by SEQ ID NO: 512, SEQ ID NO: 514, SEQ ID NO: 516, SEQ ID NO: 518 or SEQ ID NO: 520, or mutated netrin 4 represented by SEQ ID NO: 522 or SEQ ID NO: 524,
- or a fragment of one of these proteins, in particular represented by one of the sequences SEQ ID NO: 2n, n varying from 1 to 248,
- or a nucleotide sequence coding for one of the abovementioned proteins, in particular represented by one of the following nucleotide sequences: SEQ ID NO: 501, SEQ ID NO: 503, SEQ ID NO: 505, SEQ ID NO: 507, SEQ ID NO: 509, SEQ ID NO: 497, SEQ ID NO: 499, SEQ ID NO: 511, SEQ ID NO: 513, SEQ ID NO: 515, SEQ ID NO: 517, SEQ ID NO: 519, SEQ ID NO: 521, SEQ ID NO: 523, or one of the sequences SEQ ID NO: 2n-1, n varying from 1 to 248,
- or an anti-idiotypic antibody of one of the proteins as defined above, and at least one chemotherapy agent, in particular chosen from: doxorubicin, methotrexate, vinblastine, vincristine, cladribine, fluorouracil, cytarabine, anthracyclines, cisplatin, cyclophosphamide, fludarabine, gemcitabine, aromatase inhibitors, irinotecan, navelbine, oxaliplatin, taxofene, taxol or taxotere, for simultaneous or separate use or spread over time, intended for the treatment of cancer.

Within the framework of the present invention, the doses of the anti-angiogenic agent comprise approximately 10 to approximately 20,000 µg/kg of body weight. The time between the injections is in particular determined by analogy to the dose of the anti-angiogenic treatment currently available on the market under the name of Avastin.

The present invention relates to novel fragments of netrin 4.

In particular, the present invention relates to novel fragments of the netrin 4 protein, characterized in that they comprise or are constituted by one of the following sequences:
- a sequence SEQ ID NO: 2p, p varying from 1 to 63, or
- any sequence derived from one of the abovementioned sequences, in particular by substitution, suppression or addition of one or more amino acids, providing that this derived sequence exhibits anti-angiogenic activity, or
- any sequence homologous to one of the abovementioned sequences, preferably having at least approximately 50% identity with the region comprised between the amino acids at positions 261 and 515 of SEQ ID NO: 498, providing that this homologous sequence exhibits anti-angiogenic activity.

The abovementioned sequences SEQ ID NO: 2p correspond to the protein sequences SEQ ID NO: 2 to SEQ ID NO: 126, namely the following protein sequences: SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124 or SEQ ID NO: 126, as defined previously.

The fragments SEQ ID NO: 2p are novel fragments of netrin 4, exhibiting angiogenesis-inhibiting activity.

The abovementioned sequences SEQ ID NO: 2p-1 code for the abovementioned protein sequences SEQ ID NO: 2p, and correspond to the following nucleotide sequences: SEQ ID NO: 1 coding for SEQ ID NO: 2, SEQ ID NO: 3 coding for SEQ ID NO: 4, SEQ ID NO: 5 coding for SEQ ID NO: 6, SEQ ID NO: 7 coding for SEQ ID NO: 8, SEQ ID NO: 9 coding for SEQ ID NO: 10, SEQ ID NO: 11 coding for SEQ ID NO: 12, SEQ ID NO: 13 coding for SEQ ID NO: 14, SEQ ID NO: 15 coding for SEQ ID NO: 16, SEQ ID NO: 17 coding for SEQ ID NO: 18, SEQ ID NO: 19 coding for SEQ ID NO: 20, SEQ ID NO: 21 coding for SEQ ID NO: 22, SEQ ID NO: 23 coding for SEQ ID NO: 24, SEQ ID NO: 25 coding for SEQ ID NO: 26, SEQ ID NO: 27 coding for SEQ ID NO: 28, SEQ ID NO: 29 coding for SEQ ID NO: 30, SEQ ID NO: 31 coding for SEQ ID NO: 32, SEQ ID NO: 33 coding for SEQ ID NO: 34, SEQ ID NO: 35 coding for SEQ ID NO: 36, SEQ ID NO: 37 coding for SEQ ID NO: 38, SEQ ID NO: 39 coding for SEQ ID NO: 40, SEQ ID NO: 41 coding for SEQ ID NO: 42, SEQ ID NO: 43 coding for SEQ ID NO: 44, SEQ ID NO: 45 coding for SEQ ID NO: 46, SEQ ID NO: 47 coding for SEQ ID NO: 48, SEQ ID NO: 49 coding for SEQ ID NO: 50, SEQ ID NO: 51 coding for SEQ ID NO: 52, SEQ ID NO: 53 coding for SEQ ID NO: 54, SEQ ID NO: 55 coding for SEQ ID NO: 56, SEQ ID NO: 57 coding for SEQ ID NO: 58, SEQ ID NO: 59 coding for SEQ ID NO: 60, SEQ ID NO: 61 coding for SEQ ID NO: 62, SEQ ID NO: 63 coding for SEQ ID NO: 64, SEQ ID NO: 65 coding for SEQ ID NO: 66, SEQ ID NO: 67 coding for SEQ ID NO: 68, SEQ ID NO: 69 coding for SEQ ID NO: 70, SEQ ID NO: 71 coding for SEQ ID NO: 72, SEQ ID NO: 73 coding for SEQ ID NO: 74, SEQ ID NO: 75 coding for SEQ ID NO: 76, SEQ ID NO: 77 coding for SEQ ID NO: 78, SEQ ID NO: 79 coding for SEQ ID NO: 80, SEQ ID NO: 81 coding for SEQ ID NO: 82, SEQ ID NO: 83 coding for SEQ ID NO: 84, SEQ ID NO: 85 coding for SEQ ID NO: 86, SEQ ID NO: 87 coding for SEQ ID NO: 88, SEQ ID NO: 89 coding for SEQ ID NO: 90, SEQ ID NO: 91 coding for SEQ ID NO: 92, SEQ ID NO: 93 coding for SEQ ID NO: 94, SEQ ID NO: 95 coding for SEQ ID NO: 96, SEQ ID NO: 97 coding for SEQ ID NO: 98, SEQ ID NO: 99 coding for SEQ ID NO: 100, SEQ ID NO: 101 coding for SEQ ID NO: 102, SEQ ID NO: 103 coding for SEQ ID NO: 104, SEQ ID NO: 105 coding for SEQ ID NO: 106, SEQ ID NO: 107 coding for SEQ ID NO: 108, SEQ ID NO: 109 coding for SEQ ID NO: 110, SEQ ID NO: 111 coding for SEQ ID NO: 112, SEQ ID NO: 113 coding for SEQ ID NO: 114, SEQ ID NO: 115 coding for SEQ ID NO: 116, SEQ ID NO: 117 coding for SEQ ID NO: 118, SEQ ID NO: 119 coding for SEQ ID NO: 120, SEQ ID NO: 121 coding for SEQ ID NO: 122, SEQ ID NO: 123 coding for SEQ ID NO: 124 or SEQ ID NO: 125 coding for SEQ ID NO: 126.

The present invention also relates to a nucleotide sequence coding for a protein as defined above.

According to an advantageous embodiment, the nucleotide sequence according to the invention is characterized in that it comprises or is constituted by:
- one of the nucleotide sequences SEQ ID NO: 2p-1 coding for SEQ ID NO: 2p, p varying from 1 to 63,
- or any nucleotide sequence derived, by degeneration of the genetic code, from one of the abovementioned nucleotide sequences, and coding for a protein represented by SEQ ID NO: 2p, p varying from 1 to 63,
- or any nucleotide sequence derived, in particular by substitution, suppression or addition of one or more nucleotides, from one of the abovementioned nucleotide sequences coding for a protein derived from one of the sequences SEQ ID NO: 2p, p varying from 1 to 63, as defined above,
- or any nucleotide sequence homologous to one of the abovementioned nucleotide sequences, preferably having at least approximately 50% identity with one of the sequences SEQ ID NO: 2p-1 coding for a protein homologous to SEQ ID NO: 2p, as defined above, p varying from 1 to 63,
- or any nucleotide sequence complementary to the abovementioned sequences,
- or any nucleotide sequence capable of hybridizing under stringent conditions with the sequence complementary to one of the abovementioned sequences.

The expression "hybridize under stringent conditions" corresponds in particular to a hybridization buffer such as 0.5× SSC, to a hybridization temperature of 60° C., as well as to a washing medium such as 0.1×SSC with 1% of SDS added and to a washing temperature of 50° C.

The present invention also relates to a recombinant vector, in particular plasmid, cosmid, phage or virus DNA, containing a nucleotide sequence as defined above, in particular SEQ ID NO: 2p-1, p varying from 1 to 63.

An advantageous vector according to the invention contains the elements necessary for the expression in a host cell of the polypeptides encoded by the abovementioned nucleic acids, in particular SEQ ID NO: 2p-1, p varying from 1 to 63, inserted into said vector.

The present invention relates to a host cell, chosen in particular from bacteria, viruses, yeasts, fungi, plants or mammal cells, said host cell being transformed, in particular using a recombinant vector as defined above.

The present invention also relates to an antibody characterized in that it is directed specifically against a protein as mentioned above, namely a fragment of netrin 4, in particular represented by SEQ ID NO: 2p, p varying from 1 to 63.

The present invention also relates to a pharmaceutical composition, comprising as active ingredient,
- a protein as defined above, corresponding to the fragments of netrin 4, and preferably one of the sequences SEQ ID NO: 2p, p varying from 1 to 63, or
- a nucleotide sequence as defined above, in particular one of the sequences SEQ ID NO: 2p-1, p varying from 1 to 63, or
- an antibody as defined above, in particular directed against one of the sequences SEQ ID NO: 2p, p varying from 1 to 63.

The present invention also relates to the use:
- of a protein as defined above, corresponding to the fragments of netrin 4, and preferably one of the sequences SEQ ID NO: 2p, p varying from 1 to 63, or
- of a nucleotide sequence as defined above, in particular one of the sequences SEQ ID NO: 2p-1, p varying from 1 to 63, or
- of an antibody as defined above, in particular directed against one of the sequences SEQ ID NO: 2p, p varying from 1 to 63.

for the preparation of a medicament intended for the treatment of pathologies requiring the inhibition of endothelial proliferation, in particular within the context of the following pathologies: cancers and leukemias, age-related macular degeneration, diabetic retinopathies, rheumatoid polyarthritis, psoriatic polyarthritis, angiomas, angiosarcomas, Castelman's disease and Kaposi's sarcoma, or within the context of the treatment of obesity or retinal neovascularization.

The present invention relates to the use of RGM and of novel fragments of RGM. In particular, the present invention relates to the use:
- of a protein characterized in that it comprises or is constituted by:
  - the sequence SEQ ID NO: 512, SEQ ID NO: 514, SEQ ID NO: 516, SEQ ID NO: 518 or SEQ ID NO: 520,
  - a fragment of this protein, providing that this fragment exhibits anti-angiogenic activity, said fragment comprising in particular approximately 40 to approximately 150 amino acids, and being in particular represented by one of the sequences SEQ ID NO: 354, SEQ ID NO: 356 or SEQ ID NO: 358,
  - any sequence derived from the sequence SEQ ID NO: 512, SEQ ID NO: 514, SEQ ID NO: 516, SEQ ID NO: 518 or SEQ ID NO: 520, or of a fragment defined above, in particular by substitution, suppression or addition of one or more amino acids, providing that this derived sequence exhibits anti-angiogenic activity, or
  - any sequence homologous to the sequence SEQ ID NO: 512, SEQ ID NO: 514, SEQ ID NO: 516, SEQ ID NO: 518 or SEQ ID NO: 520, or of a fragment defined above, preferably having at least approximately 50% identity with the region comprised between the amino acids at position 180 and 290 of the sequence SEQ ID NO: 512, SEQ ID NO: 514, SEQ ID NO: 516, SEQ ID NO: 518 or SEQ ID NO: 520, providing that this homologous sequence exhibits anti-angiogenic activity, or of a nucleotide sequence characterized in that it comprises or is constituted by a nucleotide sequence coding:
  either for the protein as defined above,
  or for a fragment of the protein as defined above,
  or for a sequence derived from the protein as defined above,
  or for a homologous sequence of the protein as defined above,
  said nucleotide sequence corresponding in particular to the nucleotide sequence SEQ ID NO: 511 coding for SEQ ID NO: 512, or to the nucleotide sequence SEQ ID NO: 513 coding for SEQ ID NO: 514, or to the nucleotide sequence SEQ ID NO: 515 coding for SEQ ID NO: 516, or to the nucleotide sequence SEQ ID NO: 517 coding for SEQ ID NO: 518, or to the nucleotide sequence SEQ ID NO: 519 coding for SEQ ID NO: 520, or to the nucleotide sequence SEQ ID NO: 353 coding for SEQ ID NO: 354, or to the nucleotide sequence SEQ ID NO: 355 coding for SEQ ID NO: 356, or to the nucleotide sequence SEQ ID NO: 357 coding for SEQ ID NO: 358, or of an anti-idiotypic antibody of the protein as defined above, for the preparation of a medicament intended for the prevention or treatment of non-tumoral pathologies requiring the inhibition of endothelial proliferation, in particular within the context of the following pathologies: age-related macular degeneration, diabetic retinopathies, rheumatoid polyarthritis, angiomas, or within the context of the treatment of obesity or retinal neovascularization.

The present invention also relates to fragments of RGM, characterized in that they comprise or are constituted by one of the following sequences:
  a sequence SEQ ID NO: 354, SEQ ID NO: 356 or SEQ ID NO: 358, or
  any sequence derived from one of the abovementioned sequences, in particular by substitution, suppression or addition of one or more amino acids, providing that this derived sequence exhibits anti-angiogenic activity, or
  any sequence homologous to one of the abovementioned sequences, preferably having at least approximately 50% identity with the region comprised between the amino acids at position 180 and 290 of SEQ ID NO: 512, providing that this homologous sequence exhibits anti-angiogenic activity.

The present invention also relates to a nucleotide sequence coding for one of the fragments of RGM as defined above.

An advantageous nucleotide sequence according to the invention is characterized in that it comprises or is constituted by:
  the nucleotide sequence SEQ ID NO: 353, SEQ ID NO: 355 or SEQ ID NO: 357,
  or any nucleotide sequence derived, by degeneration of the genetic code, from one of the abovementioned nucleotide sequences, and coding for a protein represented by SEQ ID NO: 354, SEQ ID NO: 356 or SEQ ID NO: 358,
  or any nucleotide sequence derived, in particular by substitution, suppression or addition of one or more nucleotides, from one of the abovementioned nucleotide sequences coding for a protein derived from SEQ ID NO: 354, SEQ ID NO: 356 or SEQ ID NO: 358, as defined above,
  or any nucleotide sequence homologous to one of the abovementioned nucleotide sequences, preferably having at least approximately 50% identity with the sequence SEQ ID NO: 353, SEQ ID NO: 355 or SEQ ID NO: 357, coding for a protein homologous to SEQ ID NO: 354, SEQ ID NO: 356 or SEQ ID NO: 358, as defined above,
  or any nucleotide sequence complementary to the abovementioned sequences,
  or any nucleotide sequence capable of hybridizing under stringent conditions with the sequence complementary to one of the abovementioned sequences.

The expression "hybridize under stringent conditions" corresponds in particular to a hybridization buffer such as 0.5× SSC, a hybridization temperature of 60° C., as well as to a washing medium such as 0.1×SSC with 1% of SDS added and to a washing temperature of 50° C.

The present invention also relates to a recombinant vector, in particular plasmid, cosmid, phage or virus DNA, containing a nucleotide sequence as defined above, said recombinant vector preferably containing the elements necessary for the expression in a host cell of the polypeptides encoded by the abovementioned nucleic acids, inserted into said vector.

The present invention also relates to a host cell, chosen in particular from bacteria, viruses, yeasts, fungi, plants or mammal cells, said host cell being transformed, in particular using a recombinant vector as defined above.

The present invention relates to an antibody characterized in that it is directed specifically against one of the abovementioned fragments of RGM.

The present invention also relates to a pharmaceutical composition, comprising as active ingredient,
  one of the abovementioned fragments of RGM, or
  a nucleotide sequence as defined above, coding for one of the abovementioned fragments of RGM, or
  an antibody as defined above, directed against one of the abovementioned fragments of RGM.

The present invention also relates to the use
  of one of the abovementioned fragments of RGM, or
  of a nucleotide sequence as defined above, coding for one of the abovementioned fragments of RGM, or
  of an antibody as defined above, directed against one of the abovementioned fragments of RGM,
for the preparation of a medicament intended for the treatment of pathologies requiring the inhibition of endothelial proliferation, in particular within the context of the following pathologies: cancers and leukemia, age-related macular degeneration, diabetic retinopathies, rheumatoid polyarthritis, psoriatic polyarthritis, angiomas, angiosarcomas, Castelman's disease and Kaposi's sarcoma, or within the context of the treatment of obesity or retinal neovascularization.

The present invention also relates to the use of fragments of netrin 1, of netrin 3 and of its fragments, of netrin G1 and of its fragments, as well as the corresponding novel fragments.

In particular, the present invention relates to the use:
  of a protein characterized in that it comprises or is constituted by:
    netrin G1 represented by the sequence SEQ ID NO: 506 or by the sequence SEQ ID NO: 508, or netrin 3 represented by the sequence SEQ ID NO: 510,
    a fragment of one of these proteins or of netrin 1 represented by the sequence SEQ ID NO: 502 or SEQ ID NO: 504, providing that this fragment exhibits anti-angiogenic activity, said fragment comprising in particular approximately 40 to approximately 400 amino acids, and being in particular represented by one of the sequences SEQ ID NO: 2m, m varying from 64 to 176, or by the sequence SEQ ID NO: 372, any sequence derived from the sequence SEQ ID NO: 506, SEQ ID NO: 508, SEQ ID NO: 510, or from a fragment defined above, in particular by substitution, suppression or addition of one or more amino acids, providing that this derived sequence exhibits anti-angiogenic activity, or any sequence homologous to the sequence SEQ ID NO: 506, SEQ ID NO: 508, SEQ ID NO: 510, or of a fragment defined above, preferably having at least approximately 50% identity with the region comprised between the amino acids at position 296 and 438 of the sequence SEQ ID NO: 506, providing that this homologous sequence exhibits anti-angiogenic activity, or of a nucleotide sequence characterized in that it comprises or is constituted by a nucleotide sequence coding:
either for one of the proteins as defined above,
or for a fragment of one of the proteins as defined above,
or for a sequence derived from one of the proteins as defined above,
or for a sequence homologous to one of the proteins as defined above,
said nucleotide sequence corresponding in particular to the nucleotide sequence SEQ ID NO: 505 coding for SEQ ID NO: 506, or to the nucleotide sequence SEQ ID NO: 507 coding for SEQ ID NO: 508, or to the nucleotide sequence SEQ ID NO: 509 coding for SEQ ID NO: 510, or to a sequence SEQ ID NO: 2m-1 coding for SEQ ID NO: 2m, m varying from 64 to 176, or to the sequence SEQ ID NO: 371 coding for SEQ ID NO: 372, or of an anti-idiotypic antibody of one of the proteins as defined above,
or of an antibody of one of the proteins as defined above,
or of a Fab fragment of anti-idiotypic antibodies as defined above, for the preparation of a medicament intended for the prevention or treatment of pathologies requiring the inhibition of endothelial proliferation, in particular within the context of the following pathologies: cancers and leukemias, age-related macular degeneration, diabetic retinopathies, rheumatoid polyarthritis, psoriatic polyarthritis, angiomas, angiosarcomas, Castelman's disease and Kaposi's sarcoma, or within the context of the treatment of obesity or retinal neovascularization.

The abovementioned sequences SEQ ID NO: 2m correspond to the protein sequences SEQ ID NO: 128 to SEQ ID NO: 352, i.e. to the following protein sequences: SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294, SEQ ID NO: 296, SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350, SEQ ID NO: 352.

The abovementioned sequences SEQ ID NO: 2m-1 code for the abovementioned protein sequences SEQ ID NO: 2m, and correspond to the following nucleotide sequences: SEQ ID NO: 127 coding for SEQ ID NO: 128, SEQ ID NO: 129 coding for SEQ ID NO: 130, SEQ ID NO: 131 coding for SEQ ID NO: 132, SEQ ID NO: 133 coding for SEQ ID NO: 134, SEQ ID NO: 135 coding for SEQ ID NO: 136, SEQ ID NO: 137 coding for SEQ ID NO: 138, SEQ ID NO: 139 coding for SEQ ID NO: 140, SEQ ID NO: 141 coding for SEQ ID NO: 142, SEQ ID NO: 143 coding for SEQ ID NO: 144, SEQ ID NO: 145 coding for SEQ ID NO: 146, SEQ ID NO: 147 coding for SEQ ID NO: 148, SEQ ID NO: 149 coding for SEQ ID NO: 150, SEQ ID NO: 151 coding for SEQ ID NO: 152, SEQ ID NO: 153 coding for SEQ ID NO: 154, SEQ ID NO: 155 coding for SEQ ID NO: 156, SEQ ID NO: 157 coding for SEQ ID NO: 158, SEQ ID NO: 159 coding for SEQ ID NO: 160, SEQ ID NO: 161 coding for SEQ ID NO: 162, SEQ ID NO: 163 coding for SEQ ID NO: 164, SEQ ID NO: 165 coding for SEQ ID NO: 166, SEQ ID NO: 167 coding for SEQ ID NO: 168, SEQ ID NO: 169 coding for SEQ ID NO: 170, SEQ ID NO: 171 coding for SEQ ID NO: 172, SEQ ID NO: 173 coding for SEQ ID NO: 174, SEQ ID NO: 175 coding for SEQ ID NO: 176, SEQ ID NO: 177 coding for SEQ ID NO: 178, SEQ ID NO: 179 coding for SEQ ID NO: 180, SEQ ID NO: 181 coding for SEQ ID NO: 182, SEQ ID NO: 183 coding for SEQ ID NO: 184, SEQ ID NO: 185 coding for SEQ ID NO: 186, SEQ ID NO: 187 coding for SEQ ID NO: 188, SEQ ID NO: 189 coding for SEQ ID NO: 190, SEQ ID NO: 191 coding for SEQ ID NO: 192, SEQ ID NO: 193 coding for SEQ ID NO: 194, SEQ ID NO: 195 coding for SEQ ID NO: 196, SEQ ID NO: 197 coding for SEQ ID NO: 198, SEQ ID NO: 199 coding for SEQ ID NO: 200, SEQ ID NO: 201 coding for SEQ ID NO: 202, SEQ ID NO: 203 coding for SEQ ID NO: 204, SEQ ID NO: 205 coding for SEQ ID NO: 206, SEQ ID NO: 207 coding for SEQ ID NO: 208, SEQ ID NO: 209 coding for SEQ ID NO: 210, SEQ ID NO: 211 coding for SEQ ID NO: 212, SEQ ID NO: 213 coding for SEQ ID NO: 214, SEQ ID NO: 215 coding for SEQ ID NO: 216, SEQ ID NO: 217 coding for SEQ ID NO: 218, SEQ ID NO: 219 coding for SEQ ID NO: 220, SEQ ID NO: 221 coding for SEQ ID NO: 222, SEQ ID NO: 223 coding for SEQ ID NO: 224, SEQ ID NO: 225 coding for SEQ ID NO: 226, SEQ ID NO: 227 coding for SEQ ID NO: 228, SEQ ID NO: 229 coding for SEQ ID NO: 230, SEQ ID NO: 231 coding for SEQ ID NO: 232, SEQ ID NO: 233 coding for SEQ ID NO: 234, SEQ ID NO: 235 coding for SEQ ID NO: 236, SEQ ID NO: 237 coding for SEQ ID NO: 238, SEQ ID NO: 239 coding for SEQ ID NO: 240, SEQ ID NO: 241 coding for SEQ ID NO: 242, SEQ ID NO: 243 coding for SEQ ID NO: 244, SEQ ID NO: 245 coding for SEQ ID NO: 246, SEQ ID NO: 247 coding for SEQ ID NO: 248, SEQ ID NO: 249 coding for SEQ ID NO: 250, SEQ ID NO: 251 coding for SEQ ID NO: 252, SEQ ID NO: 253 coding for SEQ ID NO: 254, SEQ ID NO: 255 coding for SEQ ID NO: 256, SEQ ID NO: 257 coding for SEQ ID NO: 258, SEQ ID NO: 259 coding for SEQ ID NO: 260, SEQ ID NO: 261 coding for SEQ ID NO: 262, SEQ ID NO: 263 coding for SEQ ID NO: 264, SEQ ID NO: 265 coding for SEQ ID NO: 266, SEQ ID NO: 267 coding for SEQ ID NO: 268, SEQ ID NO: 269 coding for SEQ ID NO: 270, SEQ ID NO: 271 coding for SEQ ID NO: 272, SEQ ID NO: 273 coding for SEQ ID NO: 274, SEQ ID NO: 275 coding for SEQ ID NO: 276, SEQ ID NO: 277 coding for SEQ ID NO: 278, SEQ ID NO: 279 coding for SEQ ID NO: 280, SEQ ID NO: 281 coding for SEQ ID NO: 282, SEQ ID NO: 283 coding for SEQ ID NO: 284, SEQ ID NO: 285 coding for SEQ ID NO: 286, SEQ ID NO: 287 coding for SEQ ID NO: 288, SEQ ID NO: 289 coding for SEQ ID NO: 290, SEQ ID NO: 291 coding for SEQ ID NO: 292, SEQ ID NO: 293 coding for SEQ ID NO: 294, SEQ ID NO: 295 coding for SEQ ID NO: 296, SEQ ID NO: 297 coding for SEQ ID NO: 298, SEQ ID NO: 299 coding for SEQ ID NO: 300, SEQ ID NO: 301 coding for SEQ ID NO: 302, SEQ ID NO: 303 coding for SEQ ID NO: 304, SEQ ID NO: 305 coding for SEQ ID NO: 306, SEQ ID NO: 307 coding for SEQ ID NO: 308, SEQ ID NO: 309 coding for SEQ ID NO: 310, SEQ ID NO: 311 coding for SEQ ID NO: 312, SEQ ID NO: 313 coding for SEQ ID NO: 314, SEQ ID NO: 315 coding for SEQ ID NO: 316, SEQ ID NO: 317 coding for SEQ ID NO: 318, SEQ ID NO: 319 coding for SEQ ID NO: 320, SEQ ID NO: 321 coding for SEQ ID NO: 322, SEQ ID NO: 323 coding for SEQ ID NO: 324, SEQ ID NO: 325 coding for SEQ ID NO: 326, SEQ ID NO: 327 coding for SEQ ID NO: 328, SEQ ID NO: 329 coding for SEQ ID NO: 330, SEQ ID NO: 331 coding for SEQ ID NO: 332, SEQ ID NO: 333 coding for SEQ ID NO: 334, SEQ ID NO: 335 coding for SEQ ID NO: 336, SEQ ID NO: 337 coding for SEQ ID NO: 338, SEQ ID NO: 339 coding for SEQ ID NO: 340, SEQ ID NO: 341 coding for SEQ ID NO: 342, SEQ ID NO: 343 coding for SEQ ID NO: 344, SEQ ID NO: 345 coding for SEQ ID NO: 346, SEQ ID NO: 347 coding for SEQ ID NO: 348, SEQ ID NO: 349 coding for SEQ ID NO: 350, SEQ ID NO: 351 coding for SEQ ID NO: 352.

The present invention relates to a protein, characterized in that it comprises or is constituted by one of the following sequences:
  a sequence SEQ ID NO: 2i, i varying from 64 to 131, or
  any sequence derived from one of the abovementioned sequences, in particular by substitution, suppression or addition of one or more amino acids, providing that this derived sequence exhibits anti-angiogenic activity, or
  any sequence homologous to one of the abovementioned sequences, preferably having at least approximately 50% identity with the region comprised between the amino acids at position 284 and 487 of SEQ ID NO: 502, providing that this homologous sequence exhibits anti-angiogenic activity,
providing that said protein is different from the sequence SEQ ID NO: 502 or SEQ ID NO: 504.

The abovementioned sequences SEQ ID NO: 2i are fragments of netrin 1 and correspond to the protein sequences SEQ ID NO: 128 to SEQ ID NO: 262, i.e. the following protein sequences: SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260 or SEQ ID NO: 262.

The present invention also relates to the fragments of netrin G1, characterized in that they comprise or are constituted by one of the following sequences:
  a sequence SEQ ID NO: 2j, j varying from 132 to 148, or
  any sequence derived from one of the abovementioned sequences, in particular by substitution, suppression or addition of one or more amino acids, providing that this derived sequence exhibits anti-angiogenic activity, or
  any sequence homologous to one of the abovementioned sequences, preferably having at least approximately 50% identity with the region comprised between the amino acids at position 296 and 438 of SEQ ID NO: 506, providing that this homologous sequence exhibits anti-angiogenic activity.

The abovementioned sequences SEQ ID NO: 2j correspond to the protein sequences SEQ ID NO: 264 to SEQ ID NO: 296, i.e.: SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294 or SEQ ID NO: 296.

The present invention also relates to the fragments of netrin 3, characterized in that they comprise or are constituted by one of the following sequences:
  a sequence SEQ ID NO: 2k, k varying from 149 to 176, or
  any sequence derived from one of the abovementioned sequences, in particular by substitution, suppression or addition of one or more amino acids, providing that this derived sequence exhibits anti-angiogenic activity, or
  any sequence homologous to one of the abovementioned sequences, preferably having at least approximately 50% identity with the region comprised between the amino acids at position 254 and 433 of SEQ ID NO: 510, providing that this homologous sequence exhibits anti-angiogenic activity.

The abovementioned sequences SEQ ID NO: 2k correspond to the protein sequences SEQ ID NO: 298 to 352, i.e. to the following protein sequences: SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350 or SEQ ID NO: 352.

The present invention also relates to a nucleotide sequence coding for a protein as defined above, namely a nucleotide sequence coding for the fragments of netrin 1.

An advantageous nucleotide sequence according to the invention is characterized in that it comprises or is constituted by:
- the nucleotide sequence SEQ ID NO: 2i-1, i varying from 64 to 131,
- or any nucleotide sequence derived, by degeneration of the genetic code, from one of the abovementioned nucleotide sequences, and coding for a protein represented by one of the sequences SEQ ID NO: 2i, i varying from 64 to 131,
- or any nucleotide sequence derived, in particular by substitution, suppression or addition of one or more nucleotides, from one of the abovementioned nucleotide sequences coding for a protein derived from one of the sequences SEQ ID NO: 2i, i varying from 64 to 131, as defined above,
- or any nucleotide sequence homologous to one of the abovementioned nucleotide sequences, preferably having at least approximately 50% identity with one of the sequences SEQ ID NO: 2i-1 coding for a protein homologous to SEQ ID NO: 2i, i varying from 64 to 131, as defined above,
- or any nucleotide sequence complementary to the abovementioned sequences,
- or any nucleotide sequence capable of hybridizing under stringent conditions with the sequence complementary to one of the abovementioned sequences providing that said nucleotide sequence is different from the sequence SEQ ID NO: 501 or SEQ ID NO: 503.

The abovementioned sequences SEQ ID NO: 2i-1 code for the abovementioned fragments of netrin 1, represented by SEQ ID NO: 2i, and correspond to the following nucleotide sequences: SEQ ID NO: 127 coding for SEQ ID NO: 128, SEQ ID NO: 129 coding for SEQ ID NO: 130, SEQ ID NO: 131 coding for SEQ ID NO: 132, SEQ ID NO: 133 coding for SEQ ID NO: 134, SEQ ID NO: 135 coding for SEQ ID NO: 136, SEQ ID NO: 137 coding for SEQ ID NO: 138, SEQ ID NO: 139 coding for SEQ ID NO: 140, SEQ ID NO: 141 coding for SEQ ID NO: 142, SEQ ID NO: 143 coding for SEQ ID NO: 144, SEQ ID NO: 145 coding for SEQ ID NO: 146, SEQ ID NO: 147 coding for SEQ ID NO: 148, SEQ ID NO: 149 coding for SEQ ID NO: 150, SEQ ID NO: 151 coding for SEQ ID NO: 152, SEQ ID NO: 153 coding for SEQ ID NO: 154, SEQ ID NO: 155 coding for SEQ ID NO: 156, SEQ ID NO: 157 coding for SEQ ID NO: 158, SEQ ID O: 159 coding for SEQ ID NO: 160, SEQ ID NO: 161 coding for SEQ ID NO: 162, SEQ ID NO: 163 coding for SEQ ID NO: 164, SEQ ID NO: 165 coding for SEQ ID NO: 166, SEQ ID NO: 167 coding for SEQ ID NO: 168, SEQ ID NO: 169 coding for SEQ ID NO: 170, SEQ ID NO: 171 coding for SEQ ID NO: 172, SEQ ID NO: 173 coding for SEQ ID NO: 174, SEQ ID NO: 175 coding for SEQ ID NO: 176, SEQ ID NO: 177 coding for SEQ ID NO: 178, SEQ ID NO: 179 coding for SEQ ID NO: 180, SEQ ID NO: 181 coding for SEQ ID NO: 182, SEQ ID NO: 183 coding for SEQ ID NO: 184, SEQ ID NO: 185 coding for SEQ ID NO: 186, SEQ ID NO: 187 coding for SEQ ID NO: 188, SEQ ID NO: 189 coding for SEQ ID NO: 190, SEQ ID NO: 191 coding for SEQ ID NO: 192, SEQ ID NO: 193 coding for SEQ ID NO: 194, SEQ ID NO: 195 coding for SEQ ID NO: 196, SEQ ID NO: 197 coding for SEQ ID NO: 198, SEQ ID NO: 199 coding for SEQ ID NO: 200, SEQ ID NO: 201 coding for SEQ ID NO: 202, SEQ ID NO: 203 coding for SEQ ID NO: 204, SEQ ID NO: 205 coding for SEQ ID NO: 206, SEQ ID NO: 207 coding for SEQ ID NO: 208, SEQ ID NO: 209 coding for SEQ ID NO: 210, SEQ ID NO: 211 coding for SEQ ID NO: 212, SEQ ID NO: 213 coding for SEQ ID NO: 214, SEQ ID NO: 215 coding for SEQ ID NO: 216, SEQ ID NO: 217 coding for SEQ ID NO: 218, SEQ ID NO: 219 coding for SEQ ID NO: 220, SEQ ID NO: 221 coding for SEQ ID NO: 222, SEQ ID NO: 223 coding for SEQ ID NO: 224, SEQ ID NO: 225 coding for SEQ ID NO: 226, SEQ ID NO: 227 coding for SEQ ID NO: 228, SEQ ID NO: 229 coding for SEQ ID NO: 230, SEQ ID NO: 231 coding for SEQ ID NO: 232, SEQ ID NO: 233 coding for SEQ ID NO: 234, SEQ ID NO: 235 coding for SEQ ID NO: 236, SEQ ID NO: 237 coding for SEQ ID NO: 238, SEQ ID NO: 239 coding for SEQ ID NO: 240, SEQ ID NO: 241 coding for SEQ ID NO: 242, SEQ ID NO: 243 coding for SEQ ID NO: 244, SEQ ID NO: 245 coding for SEQ ID NO: 246, SEQ ID NO: 247 coding for SEQ ID NO: 248, SEQ ID NO: 249 coding for SEQ ID NO: 250, SEQ ID NO: 251 coding for SEQ ID NO: 252, SEQ ID NO: 253 coding for SEQ ID NO: 254, SEQ ID NO: 255 coding for SEQ ID NO: 256, SEQ ID NO: 257 coding for SEQ ID NO: 258, SEQ ID NO: 259 coding for SEQ ID NO: 260 or SEQ ID NO: 261 coding for SEQ ID NO: 262.

The present invention also relates to a pharmaceutical composition, comprising as active ingredient,
- a protein corresponding to the fragments of netrin 1, as defined above, or
- a nucleotide sequence coding for said fragments of netrin 1, as defined above, or
- an antibody, characterized in that it is directed specifically against a protein as defined above, or
- an anti-idiotypic antibody of a protein as defined above, or
- a Fab fragment of anti-idiotypic antibodies of a protein as defined above.

The present invention relates to the use:
- of a protein corresponding to the fragments of netrin 1, as defined above, or
- of a nucleotide sequence coding for said fragments of netrin 1, as defined above, or
- of an anti-idiotypic antibody of a protein as defined above, for the preparation of a medicament intended for the prevention or treatment of pathologies requiring the inhibition of endothelial proliferation and/or migration, in particular within the context of the following pathologies: cancers and leukemias, age-related macular degeneration, choroidal neovascularization complicating myopia, neovascularization of the cornea in particular graft rejection, glaucoma, diabetic retinopathies or retinopathies of premature infants, diabetic retinopathies, rheumatoid polyarthritis, psoriatic polyarthritis, angiomas, angiosarcomas, Castelman's disease and Kaposi's sarcoma, or within the context of the treatment of obesity or retinal neovascularization.

The present invention also relates to the use:
- of an antibody, characterized in that it is directed specifically against a protein as defined above, or
- of a Fab fragment of anti-idiotypic antibodies of a protein as defined above, for the preparation of a medicament intended for the prevention or treatment of pathologies requiring the stimulation of endothelial proliferation and/or migration, in particular within the context of the following pathologies: ischemic pathologies such as arteritis of the lower limbs, myocardial infarction, cerebral vascular accidents, sclerodermia or Raynaud's disease.

The present invention also relates to a nucleotide sequence coding for a protein as defined above, namely a nucleotide sequence coding for the fragments of netrin G1.

An advantageous nucleotide sequence according to the invention is characterized in that it comprises or is constituted by:
- the nucleotide sequence SEQ ID NO: 2j-1, j varying from 132 to 148,
- or any nucleotide sequence derived, by degeneration of the genetic code, from one of the abovementioned nucleotide sequences, and coding for a protein represented by one of the sequences SEQ ID NO: 2j, j varying from 132 to 148,
- or any nucleotide sequence derived, in particular by substitution, suppression or addition of one or more nucleotides, from one of the abovementioned nucleotide sequences coding for a protein derived from one of the sequences SEQ ID NO: 2j, j varying from 132 to 148, as defined above,
- or any nucleotide sequence homologous to one of the abovementioned nucleotide sequences, preferably having at least approximately 50% identity with one of the sequences SEQ ID NO: 2j-1 coding for a protein homologous to one of the sequences SEQ ID NO: 2j, j varying from 132 to 148, as defined above,
- or any nucleotide sequence complementary to the abovementioned sequences,
- or any nucleotide sequence capable of hybridizing under stringent conditions with the sequence complementary to one of the abovementioned sequences.

The abovementioned sequences SEQ ID NO: 2j-1 code for the abovementioned fragments of netrin G1, represented by SEQ ID NO: 2j, and correspond to the following nucleotide sequences: SEQ ID NO: 263 coding for SEQ ID NO: 264, SEQ ID NO: 265 coding for SEQ ID NO: 266, SEQ ID NO: 267 coding for SEQ ID NO: 268, SEQ ID NO: 269 coding for SEQ ID NO: 270, SEQ ID NO: 271 coding for SEQ ID NO: 272, SEQ ID NO: 273 coding for SEQ ID NO: 274, SEQ ID NO: 275 coding for SEQ ID NO: 276, SEQ ID NO: 277 coding for SEQ ID NO: 278, SEQ ID NO: 279 coding for SEQ ID NO: 280, SEQ ID NO: 281 coding for SEQ ID NO: 282, SEQ ID NO: 283 coding for SEQ ID NO: 284, SEQ ID NO: 285 coding for SEQ ID NO: 286, SEQ ID NO: 287 coding for SEQ ID NO: 288, SEQ ID NO: 289 coding for SEQ ID NO: 290, SEQ ID NO: 291 coding for SEQ ID NO: 292, SEQ ID NO: 293 coding for SEQ ID NO: 294 or SEQ ID NO: 295 coding for SEQ ID NO: 296.

The present invention also relates to a nucleotide sequence coding for a protein as defined above, namely a nucleotide sequence coding for the fragments of netrin 3.

An advantageous nucleotide sequence according to the invention is characterized in that it comprises or is constituted by:
- the nucleotide sequence SEQ ID NO: 2k-1, k varying from 149 to 176,
- or any nucleotide sequence derived, by degeneration of the genetic code, from one of the abovementioned nucleotide sequences, and coding for a protein represented by one of the sequences SEQ ID NO: 2k, k varying from 149 to 176,
- or any nucleotide sequence derived, in particular by substitution, suppression or addition of one or more nucleotides, from one of the abovementioned nucleotide sequences coding for a protein derived from one of the sequences SEQ ID NO: 2k, k varying from 149 to 176, as defined above,
- or any nucleotide sequence homologous to one of the abovementioned nucleotide sequences, preferably having at least approximately 50% identity with one of the sequences SEQ ID NO: 2k-1 coding for a protein homologous to one of the sequences SEQ ID NO: 2k, k varying from 149 to 176, as defined above,
- or any nucleotide sequence complementary to the abovementioned sequences,
- or any nucleotide sequence capable of hybridizing under stringent conditions with the sequence complementary to one of the abovementioned sequences.

The abovementioned sequences SEQ ID NO: 2k-1 code for the abovementioned fragments of netrin 3, represented by SEQ ID NO: 2k, and correspond to the following nucleotide sequences: SEQ ID NO: 297 coding for SEQ ID NO: 298, SEQ ID NO: 299 coding for SEQ ID NO: 300, SEQ ID NO: 301 coding for SEQ ID NO: 302, SEQ ID NO: 303 coding for SEQ ID NO: 304, SEQ ID NO: 305 coding for SEQ ID NO: 306, SEQ ID NO: 307 coding for SEQ ID NO: 308, SEQ ID NO: 309 coding for SEQ ID NO: 310, SEQ ID NO: 311 coding for SEQ ID NO: 312, SEQ ID NO: 313 coding for SEQ ID NO: 314, SEQ ID NO: 315 coding for SEQ ID NO: 316, SEQ ID NO: 317 coding for SEQ ID NO: 318, SEQ ID NO: 319 coding for SEQ ID NO: 320, SEQ ID NO: 321 coding for SEQ ID NO: 322, SEQ ID NO: 323 coding for SEQ ID NO: 324, SEQ ID NO: 325 coding for SEQ ID NO: 326, SEQ ID NO: 327 coding for SEQ ID NO: 328, SEQ ID NO: 329 coding for SEQ ID NO: 330, SEQ ID NO: 331 coding for SEQ ID NO: 332, SEQ ID NO: 333 coding for SEQ ID NO: 334, SEQ ID NO: 335 coding for SEQ ID NO: 336, SEQ ID NO: 337 coding for SEQ ID NO: 338, SEQ ID NO: 339 coding for SEQ ID NO: 340, SEQ ID NO: 341 coding for SEQ ID NO: 342, SEQ ID NO: 343 coding for SEQ ID NO: 344, SEQ ID NO: 345 coding for SEQ ID NO: 346, SEQ ID NO: 347 coding for SEQ ID NO: 348, SEQ ID NO: 349 coding for SEQ ID NO: 350 or SEQ ID NO: 351 coding for SEQ ID NO: 352.

The present invention also relates to a recombinant vector, in particular plasmid, cosmid, phage or virus DNA, containing a nucleotide sequence as defined above, namely a nucleotide sequence coding for one of the fragments of netrin 1, of netrin 3, or of netrin G, said recombinant vector being in particular characterized in that it contains the elements necessary for the expression in a host cell of the polypeptides encoded by the abovementioned nucleic acids, inserted into said vector.

The present invention also relates to a host cell, chosen in particular from bacteria, viruses, yeasts, fungi, plants or mammal cells, said host cell being transformed, in particular using a recombinant vector as defined above.

The present invention also relates to an antibody characterized in that it is directed specifically against a protein as defined above, in particular directed against a fragment of netrin 1, of netrin 3, or of netrin G or as defined above.

The present invention also relates to a pharmaceutical composition, comprising as active ingredient,
- one of the abovementioned fragments of netrin 1, of netrin 3, or of netrin G, or
- a nucleotide sequence as defined above, coding for one of the abovementioned fragments of netrin 1, of netrin 3, or of netrin G, or
- an antibody as defined above, directed against one of the abovementioned fragments of netrin 1, of netrin 3, of netrin G, or
- an abovementioned anti-idiotypic antibody of netrin 1, of netrin 3, or of netrin G, or
- a Fab fragment of anti-idiotypic antibodies as defined above.

The present invention also relates to the use:
of a protein characterized in that it comprises or is constituted by one of the following sequences:

a sequence SEQ ID NO: 2i, i varying from 64 to 131, or
any sequence derived from one of the abovementioned sequences, in particular by substitution, suppression or addition of one or more amino acids, providing that this derived sequence exhibits anti-angiogenic activity, or
any sequence homologous to one of the abovementioned sequences, preferably having at least approximately 50% identity with the region comprised between the amino acids at position 284 and 487 of SEQ ID NO: 502, providing that this homologous sequence exhibits anti-angiogenic activity, providing that said protein is different from the sequence SEQ ID NO: 502 or SEQ ID NO: 504 or a nucleotide sequence coding for one of the abovementioned proteins, or an antibody characterized in that it is directed specifically against a protein as defined above, or an anti-idiotypic antibody of a protein as defined above, or a Fab fragment of anti-idiotypic antibodies as defined above, for the preparation of a medicament intended for the prevention or treatment of pathologies requiring the inhibition of endothelial proliferation, in particular within the context of the following pathologies: cancers and leukemias, choroidal neovascularization complicating myopia, the neovascularization of the cornea in particular graft rejection, glaucoma, diabetic retinopathies or retinopathies of premature infants, rheumatoid polyarthritis, psoriatic polyarthritis, angiomas, angiosarcomas, Castelman's disease and Kaposi's sarcoma, or within the context of the treatment of obesity or retinal neovascularization.

The present invention relates to the novel uses of netrins.

In particular, the present invention relates to the use:
of a protein characterized in that it comprises or is constituted by:
netrin G1 represented by the sequence SEQ ID NO: 506 or by the sequence SEQ ID NO: 508, netrin 3 represented by the sequence SEQ ID NO: 510 or netrin 4 represented by the sequence SEQ ID NO: 498 or by the sequence SEQ ID NO: 500, a fragment of one of these proteins or of netrin 1 represented by the sequence SEQ ID NO: 502 or SEQ ID NO: 504, providing that this fragment exhibits pericyte activation activity, said fragment comprising in particular approximately 40 to approximately 400 amino acids, and being in particular represented by one of the sequences SEQ ID NO: 2m, m varying from 1 to 176, or by the sequence SEQ ID NO: 372, any sequence derived from the sequence SEQ ID NO: 506, SEQ ID NO: 508, SEQ ID NO: 510, SEQ ID NO: 498, SEQ ID NO: 500 or of a fragment defined above, in particular by substitution, suppression or addition of one or more amino acids, providing that this derived sequence exhibits pericyte activation activity, or any sequence homologous to the sequence SEQ ID NO: 506, SEQ ID NO: 508, SEQ ID NO: 510, SEQ ID NO: 498, SEQ ID NO: 500 or of a fragment defined above, preferably having at least approximately 50% identity with the region comprised between the amino acids at position 296 and 438 of the sequence SEQ ID NO: 506, providing that this homologous sequence exhibits pericyte activation activity, or of a nucleotide sequence characterized in that it comprises or is constituted by a nucleotide sequence coding:
either for one of the proteins as defined above,
or for a fragment of one of the proteins as defined above,
or for a sequence derived from one of the proteins as defined above,
or for a sequence homologous to one of the proteins as defined above,
said nucleotide sequence corresponding in particular to the nucleotide sequence SEQ ID NO: 505 coding for SEQ ID NO: 506, or to the nucleotide sequence SEQ ID NO: 507 coding for SEQ ID NO: 508, or to the nucleotide sequence SEQ ID NO: 509 coding for SEQ ID NO: 510, or to the nucleotide sequence SEQ ID NO: 497 coding for SEQ ID NO: 498, or to the nucleotide sequence SEQ ID NO: 499 coding for SEQ ID NO: 500, or to a sequence SEQ ID NO: 2m-1 coding for SEQ ID NO: 2m, m varying from 1 to 176, or to the sequence SEQ ID NO: 371 coding for SEQ ID NO: 372, or of an anti-idiotypic antibody of one of the proteins as defined above, or of an antibody of one of the proteins as defined above, or of a Fab fragment of anti-idiotypic antibodies as defined above, for the preparation of a medicament intended for the prevention or treatment of the non-tumoral pathologies linked to, or caused by, a rarefaction of the pericytes or the smooth muscle cells.

The present invention also relates to the use as defined above of the netrin 4 protein, represented by the sequence SEQ ID NO: 498 or SEQ ID NO: 500, for the preparation of a medicament capable of being administered at a rate of approximately 0.1 to approximately 20 mg/kg, in particular by intravenous route, by sub-cutaneous route, by systemic route, by intravitreal injection, by local route by means of infiltrations or by means of a collyrium, optionally combined with electropermeation.

The present invention also relates to the use as defined above, characterized in that the activity of inhibition of atheroma plaque formation is measured according to the abovementioned proliferation or migration test, and in that this inhibition activity corresponds to an inhibition percentage of 20% to 100% of the atheroma plaques obtained in the absence of the protein, or of the nucleotide sequence or of the anti-idiotypic antibodies as defined above.

The anti-atheroma activity is measured by the test as described in Arnal et al. (2003).

According to an advantageous embodiment, the present invention relates to the use as defined above of anti-idiotypic antibodies of a netrin, in particular the mutated or non-mutated netrin 4 protein, represented by the sequence SEQ ID NO: 522 or SEQ ID NO: 524, and by the sequence SEQ ID NO: 498 or SEQ ID NO: 500, recognizing the receptor UNC5H4 at the surface of the pericytes or smooth muscle cells, for the preparation of a medicament intended for the prevention or treatment of the following pathologies:

age-related macular degeneration, choroidal neovascularization complicating myopia
diabetic retinopathies or retinopathies of premature infants,
neovascular glaucoma (of the cornea, of the retina etc.)
corneal neovascularizations in particular graft rejection
rheumatoid polyarthritis,
psoriasis, in particular psoriatic polyarthritis,
angiomas,
atherosclerosis,
obesity,
intestinal malformations,
Crohn's disease, vascular, sub-cortical vascular dementia of which Cadasil is an example,
Alzheimer's disease,
degenerative bone pathologies and fractures, and
aneurysms and vascular dissections.

The present invention also relates to the use of the receptor UNC5H4 at the surface of the pericytes or smooth muscle cells, or of pericytes or smooth muscle cells carrying these receptors, for the implementation of a method for screening compounds activating the proliferation or migration of the pericytes or smooth muscle cells.

The present invention relates to a method for screening compounds activating the proliferation or migration of the pericytes or smooth muscle cells, characterized in that it comprises the following stages:
  measurement of the inhibition of the binding of netrin 4 to its receptor UNC5H4, or of the inhibition of mitogenic, chemotactic, anti-apoptotic activity or differentiation of netrins or of any other netrin-type factor on the smooth muscle cells or pericytes, and
  measurement of the loss of inhibition of the mitogenic or chemotactic or anti-apoptotic activity or differentiation of the netrins or of any other netrin-type factor on the smooth muscle cells or pericytes, by addition of an antibody neutralizing the receptor UNC5H4.

The tests used within the context of this screening method are the proliferation or migration tests as described above.

The present invention relates to a method for screening compounds modulating the bond between the receptor UNC5H4 and mutated or non-mutated netrin 4, represented by the sequence SEQ ID NO: 522 or SEQ ID NO: 524, or by the sequence SEQ ID NO: 498 or SEQ ID NO: 500, characterized in that it comprises the following stages:
  the bringing together of said modulating compound with the receptor UNC5H4 and netrin 4, and
  measurement of the level of specific binding between the receptor UNC5H4 and netrin 4, a difference in said level in the presence of said compound with respect to the normal level in the absence of said compound being an indication of the property of said compound to modulate the bond between the receptor UNC5H4 and netrin 4.

The screening test is carried out as follows:

Goat immunoglobulins directed against the Fc domains of human IgGs are incubated on microtitration plates (0.1-20 μg/ml in 50 mM carbonate buffer, pH 9.6). After saturation of the non-specific sites by a solution of serum albumin diluted to 5 mg/ml in the same buffer, the proteins containing the extracellular domains of the receptor UNC5H4 fused to an Fc sequence of Human IgG are immobilized on the microtitration plates (incubation at a concentration comprised between 1 and 1000 ng/ml). The compounds are added diluted in series in PBS buffer containing 0.05% of Tween 20 and 10-500 pg of netrin 1, 3, 4 or G labelled by any convenient process (radioactive iodine, biotin, fluorochrome). After rinsing, the quantity of netrin bound to the receptor is shown either by the addition of an appropriate concentration of anti-netrin antibody coupled with peroxidase, or by measurement of radioactivity, or by the addition of avidin coupled with peroxidase, or by measurement of fluorescence. The peroxidase is then shown by a colorimetric reaction. In all cases, the quantity of compound to be tested is measured by its ability to inhibit the quantity of fixed netrin.

| | Protein sequence | Nucleotide sequence |
|---|---|---|
| Proteins | | |
| Netrin 4 (with signal peptide)(1-628) | SEQ ID NO: 498 | SEQ ID NO: 497 |
| Netrin 4 (without signal peptide)(20-628) | SEQ ID NO: 500 | SEQ ID NO: 499 |
| Netrin 1 (with signal peptide)(1-604) | SEQ ID NO: 502 | SEQ ID NO: 501 |
| Netrin 1 (without signal peptide)(25-604) | SEQ ID NO: 504 | SEQ ID NO: 503 |
| Netrin G1 (with signal peptide)(1-438) | SEQ ID NO: 506 | SEQ ID NO: 505 |
| Netrin G1 (without signal peptide)(29-438) | SEQ ID NO: 508 | SEQ ID NO: 507 |
| Netrin 3 (1-580) | SEQ ID NO: 510 | SEQ ID NO: 509 |
| RGMA (1-450) | SEQ ID NO: 512 | SEQ ID NO: 511 |
| RGMB (1-437) | SEQ ID NO: 514 | SEQ ID NO: 513 |
| RGMC (1-426) | SEQ ID NO: 516 | SEQ ID NO: 515 |
| RGMB without signal peptide (46-437) | SEQ ID NO: 518 | SEQ ID NO: 517 |
| RGMC without signal peptide (36-426) | SEQ ID NO: 520 | SEQ ID NO: 519 |
| Mutated netrin 4 (with signal peptide)(1-628) | SEQ ID NO: 522 | SEQ ID NO: 521 |
| Mutated netrin 4 (without signal peptide)(20-628) | SEQ ID NO: 524 | SEQ ID NO: 523 |
| Fragments of netrin 4 | | |
| 1 (1-260) | SEQ ID NO: 360 | SEQ ID NO: 359 |
| 2 (261-515) | SEQ ID NO: 362 | SEQ ID NO: 361 |
| 3 (516-628) | SEQ ID NO: 364 | SEQ ID NO: 363 |
| 1 + 2 (1-515) | SEQ ID NO: 366 | SEQ ID NO: 365 |
| 1a + 2 (32-515) | SEQ ID NO: 368 | SEQ ID NO: 367 |
| 1a + 2 + 3 (32-628) | SEQ ID NO: 370 | SEQ ID NO: 369 |
| 2a (261-320) | SEQ ID NO: 2 | SEQ ID NO: 1 |
| 2b (332-387) | SEQ ID NO: 4 | SEQ ID NO: 3 |
| 2c (394-445) | SEQ ID NO: 6 | SEQ ID NO: 5 |
| 1a (32-260) | SEQ ID NO: 8 | SEQ ID NO: 7 |
| 1 + 3 (1-260 + 516-628) | SEQ ID NO: 10 | SEQ ID NO: 9 |
| 2 + 3 (261-628) | SEQ ID NO: 12 | SEQ ID NO: 11 |
| 1 + 2a (1-260 + 261-320) | SEQ ID NO: 14 | SEQ ID NO: 13 |
| 1 + 2b (1-260 + 332-387) | SEQ ID NO: 16 | SEQ ID NO: 15 |
| 1 + 2c (1-260 + 394-445) | SEQ ID NO: 18 | SEQ ID NO: 17 |
| 1a + 2a (32-260 + 261-320) | SEQ ID NO: 20 | SEQ ID NO: 19 |
| 1a + 2b (32-260 + 332-387) | SEQ ID NO: 22 | SEQ ID NO: 21 |
| 1a + 2c (32-260 + 394-445) | SEQ ID NO: 24 | SEQ ID NO: 23 |
| 2a + 2b (261-320 + 332-387) | SEQ ID NO: 26 | SEQ ID NO: 25 |
| 2b + 2c (332-387 + 394-445) | SEQ ID NO: 28 | SEQ ID NO: 27 |

|  | Protein sequence | Nucleotide sequence |
|---|---|---|
| 2a + 2c (261-320 + 394-445) | SEQ ID NO: 30 | SEQ ID NO: 29 |
| 2a + 2b + 2c (261-320 + 332-387 + 394-445) | SEQ ID NO: 32 | SEQ ID NO: 31 |
| 1 + 2a + 2b (1-260 + 261-320 + 332-387) | SEQ ID NO: 34 | SEQ ID NO: 33 |
| 1 + 2b + 2c (1-260 + 332-387 + 394-445) | SEQ ID NO: 36 | SEQ ID NO: 35 |
| 1 + 2a + 2c (1-260 + 261-320 + 394-445) | SEQ ID NO: 38 | SEQ ID NO: 37 |
| 1a + 2a + 2b (32-260 + 261-320 + 332-387) | SEQ ID NO: 40 | SEQ ID NO: 39 |
| 1a + 2b + 2c (32-260 + 332-387 + 394-445) | SEQ ID NO: 42 | SEQ ID NO: 41 |
| 1a + 2a + 2c (32-260 + 261-320 + 394-445) | SEQ ID NO: 44 | SEQ ID NO: 43 |
| 1 + 2a + 2b + 2c (1-260 + 261-320 + 332-387 + 394-445) | SEQ ID NO: 46 | SEQ ID NO: 45 |
| 1a + 2a + 2b + 2c (32-260 + 261-320 + 332-387 + 394-445) | SEQ ID NO: 48 | SEQ ID NO: 47 |
| 2a + 3 (261-320 + 516-628) | SEQ ID NO: 50 | SEQ ID NO: 49 |
| 2b + 3 (332-387 + 516-628) | SEQ ID NO: 52 | SEQ ID NO: 51 |
| 2c + 3 (394-445 + 516-628) | SEQ ID NO: 54 | SEQ ID NO: 53 |
| 1a + 3 (32-260 + 516-628) | SEQ ID NO: 56 | SEQ ID NO: 55 |
| 1a + 2a + 3 (32-260 + 261-320 + 516-628) | SEQ ID NO: 58 | SEQ ID NO: 57 |
| 1a + 2b + 3 (32-260 + 332-387 + 516-628) | SEQ ID NO: 60 | SEQ ID NO: 59 |
| 1a + 2c + 3 (32-260 + 394-445 + 516-628) | SEQ ID NO: 62 | SEQ ID NO: 61 |
| 1 + 2a + 3 (1-260 + 261-320 + 516-628) | SEQ ID NO: 64 | SEQ ID NO: 63 |
| 1 + 2b + 3 (1-260 + 332-387 + 516-628) | SEQ ID NO: 66 | SEQ ID NO: 65 |
| 1 + 2c + 3 (1-260 + 394-445 + 516-628) | SEQ ID NO: 68 | SEQ ID NO: 67 |
| 2a + 2b + 3 (261-320 + 332-387 + 516-628) | SEQ ID NO: 70 | SEQ ID NO: 69 |
| 2a + 2c + 3 (261-320 + 394-445 + 516-628) | SEQ ID NO: 72 | SEQ ID NO: 71 |
| 2b + 2c + 3 (332-387 + 394-445 + 516-628) | SEQ ID NO: 74 | SEQ ID NO: 73 |
| 2a + 2b + 2c + 3 (261-320 + 332-387 + 394-445 + 516-628) | SEQ ID NO: 76 | SEQ ID NO: 75 |
| 1 + 2a + 2b + 3 (1-260 + 261-320 + 332-387 + 516-628) | SEQ ID NO: 78 | SEQ ID NO: 77 |
| 1 + 2b + 2c + 3 (1-260 + 332-387 + 394-445 + 516-628) | SEQ ID NO: 80 | SEQ ID NO: 79 |
| 1 + 2a + 2c + 3 (1-260 + 261-320 + 394-445 + 516-628) | SEQ ID NO: 82 | SEQ ID NO: 81 |
| 1a + 2a + 2b + 3 (32-260 + 261-320 + 332-387 + 516-628) | SEQ ID NO: 84 | SEQ ID NO: 83 |
| 1a + 2b + 2c + 3 (32-260 + 332-387 + 394-445 + 516-628) | SEQ ID NO: 86 | SEQ ID NO: 85 |
| 1a + 2a + 2c + 3 (32-260 + 261-320 + 394-445 + 516-628) | SEQ ID NO: 88 | SEQ ID NO: 87 |
| 1 + 2a + 2b + 2c + 3 (1-260 + 261-320 + 332-387 + 394-445 + 516-628) | SEQ ID NO: 90 | SEQ ID NO: 89 |
| 1a + 2a + 2b + 2c + 3 (32-260 + 261-320 + 332-387 + 394-445 + 516-628) | SEQ ID NO: 92 | SEQ ID NO: 91 |
| 1 without signal peptide (20-260) | SEQ ID NO: 94 | SEQ ID NO: 93 |
| 1 + 2 without signal peptide (20-516) | SEQ ID NO: 96 | SEQ ID NO: 95 |
| 1 + 3 without signal peptide (20-260 + 516-628) | SEQ ID NO: 98 | SEQ ID NO: 97 |
| 1 + 2a without signal peptide (20-260 + 261-320) | SEQ ID NO: 100 | SEQ ID NO: 99 |
| 1 + 2b without signal peptide (20-260 + 332-387) | SEQ ID NO: 102 | SEQ ID NO: 101 |
| 1 + 2c without signal peptide (20-260 + 394-445) | SEQ ID NO: 104 | SEQ ID NO: 103 |
| 1 + 2a + 2b without signal peptide (20-260 + 261-320 + 332-387) | SEQ ID NO: 106 | SEQ ID NO: 105 |
| 1 + 2b + 2c without signal peptide (20-260 + 332-387 + 394-445) | SEQ ID NO: 108 | SEQ ID NO: 107 |
| 1 + 2a + 2c without signal peptide (20-260 + 261-320 + 394-445) | SEQ ID NO: 110 | SEQ ID NO: 109 |
| 1 + 2a + 2b + 2c without signal peptide (20-260 + 261-320 + 332-387 + 394-445) | SEQ ID NO: 112 | SEQ ID NO: 111 |
| 1 + 2a + 3 without signal peptide (20-260 + 261-320 + 516-628) | SEQ ID NO: 114 | SEQ ID NO: 113 |
| 1 + 2b + 3 without signal peptide (20-260 + 332-387 + 516-628) | SEQ ID NO: 116 | SEQ ID NO: 115 |
| 1 + 2c + 3 without signal peptide (20-260 + 394-445 + 516-628) | SEQ ID NO: 118 | SEQ ID NO: 117 |
| 1 + 2a + 2b + 3 without signal peptide (20-260 + 261-320 + 332-387 + 516-628) | SEQ ID NO: 120 | SEQ ID NO: 119 |
| 1 + 2b + 2c + 3 without signal peptide (20-260 + 332-387 + 394-445 + 516-628) | SEQ ID NO: 122 | SEQ ID NO: 121 |
| 1 + 2a + 2c + 3 without signal peptide (20-260 + 261-320 + 394-445 + 516-628) | SEQ ID NO: 124 | SEQ ID NO: 123 |
| 1 + 2a + 2b + 2c + 3 without signal peptide (20-260 + 261-320 + 332-387 + 394-445 + 516-628) | SEQ ID NO: 126 | SEQ ID NO: 125 |
| Fragments of netrin 1 | | |
| 1 (1-283) | SEQ ID NO: 128 | SEQ ID NO: 127 |
| 2 (284-487) | SEQ ID NO: 130 | SEQ ID NO: 129 |
| 3 (488-604) | SEQ ID NO: 132 | SEQ ID NO: 131 |
| 1 + 2 (1-487) | SEQ ID NO: 372 | SEQ ID NO: 371 |
| 2a (284-331) | SEQ ID NO: 134 | SEQ ID NO: 133 |
| 2b (341-396) | SEQ ID NO: 136 | SEQ ID NO: 135 |
| 2c (403-450) | SEQ ID NO: 138 | SEQ ID NO: 137 |
| 1a (49-283) | SEQ ID NO: 140 | SEQ ID NO: 139 |
| 1 + 3 (1-283 + 488-604) | SEQ ID NO: 142 | SEQ ID NO: 141 |
| 2 + 3 (284-604) | SEQ ID NO: 144 | SEQ ID NO: 143 |
| 1a + 2 (49-487) | SEQ ID NO: 146 | SEQ ID NO: 145 |
| 1a + 2 + 3 (49-604) | SEQ ID NO: 148 | SEQ ID NO: 147 |
| 1 + 2a (1-283 + 284-331) | SEQ ID NO: 150 | SEQ ID NO: 149 |
| 1 + 2b (1-283 + 341-396) | SEQ ID NO: 152 | SEQ ID NO: 151 |
| 1 + 2c (1-283 + 403-450) | SEQ ID NO: 154 | SEQ ID NO: 153 |
| 1a + 2a (49-283 + 284-331) | SEQ ID NO: 156 | SEQ ID NO: 155 |
| 1a + 2b (49-283 + 341-396) | SEQ ID NO: 158 | SEQ ID NO: 157 |
| 1a + 2c (49-283 + 403-450) | SEQ ID NO: 160 | SEQ ID NO: 159 |
| 2a + 2b (284-331 + 341-396) | SEQ ID NO: 162 | SEQ ID NO: 161 |
| 2b + 2c (341-396 + 403-450) | SEQ ID NO: 164 | SEQ ID NO: 163 |
| 2a + 2c (284-331 + 403-450) | SEQ ID NO: 166 | SEQ ID NO: 165 |
| 2a + 2b + 2c (284-331 + 341-396 + 403-450) | SEQ ID NO: 168 | SEQ ID NO: 167 |
| 1 + 2a + 2b (1-283 + 284-331 + 341-396) | SEQ ID NO: 170 | SEQ ID NO: 169 |
| 1 + 2b + 2c (1-283 + 341-396 + 403-450) | SEQ ID NO: 172 | SEQ ID NO: 171 |
| 1 + 2a + 2c (1-283 + 284-331 + 403-450) | SEQ ID NO: 174 | SEQ ID NO: 173 |
| 1a + 2a + 2b (49-283 + 284-331 + 341-396) | SEQ ID NO: 176 | SEQ ID NO: 175 |

|  | Protein sequence | Nucleotide sequence |
|---|---|---|
| 1a + 2b + 2c (49-283 + 341-396 + 403-450) | SEQ ID NO: 178 | SEQ ID NO: 177 |
| 1a + 2a + 2c (49-283 + 284-331 + 403-450) | SEQ ID NO: 180 | SEQ ID NO: 179 |
| 1 + 2a + 2b + 2c (1-283 + 284-331 + 341-396 + 403-450) | SEQ ID NO: 182 | SEQ ID NO: 181 |
| 1a + 2a + 2b + 2c (49-283 + 284-331 + 341-396 + 403-450) | SEQ ID NO: 184 | SEQ ID NO: 183 |
| 2a + 3 (284-331 + 488-604) | SEQ ID NO: 186 | SEQ ID NO: 185 |
| 2b + 3 (341-396 + 488-604) | SEQ ID NO: 188 | SEQ ID NO: 187 |
| 2c + 3 (403-450 + 488-604) | SEQ ID NO: 190 | SEQ ID NO: 189 |
| 1a + 3 (49-283 + 488-604) | SEQ ID NO: 192 | SEQ ID NO: 191 |
| 1a + 2a + 3 (49-283 + 284-331 + 488-604) | SEQ ID NO: 194 | SEQ ID NO: 193 |
| 1a + 2b + 3 (49-283 + 341-396 + 488-604) | SEQ ID NO: 196 | SEQ ID NO: 195 |
| 1a + 2c + 3 (49-283 + 403-450 + 488-604) | SEQ ID NO: 198 | SEQ ID NO: 197 |
| 1 + 2a + 3 (1-283 + 284-331 + 488-604) | SEQ ID NO: 200 | SEQ ID NO: 199 |
| 1 + 2b + 3 (1-283 + 341-396 + 488-604) | SEQ ID NO: 202 | SEQ ID NO: 201 |
| 1 + 2c + 3 (1-283 + 403-450 + 488-604) | SEQ ID NO: 204 | SEQ ID NO: 203 |
| 2a + 2b + 3 (284-331 + 341-396 + 488-604) | SEQ ID NO: 206 | SEQ ID NO: 205 |
| 2a + 2c + 3 (284-331 + 403-450 + 488-604) | SEQ ID NO: 208 | SEQ ID NO: 207 |
| 2b + 2c + 3 (341-396 + 403-450 + 488-604) | SEQ ID NO: 210 | SEQ ID NO: 209 |
| 2a + 2b + 2c + 3 (284-331 + 341-396 + 403-450 + 488-604) | SEQ ID NO: 212 | SEQ ID NO: 211 |
| 1 + 2a + 2b + 3 (1-283 + 284-331 + 341-396 + 488-604) | SEQ ID NO: 214 | SEQ ID NO: 213 |
| 1 + 2b + 2c + 3 (1-283 + 341-396 + 403-450 + 488-604) | SEQ ID NO: 216 | SEQ ID NO: 215 |
| 1 + 2a + 2c + 3 (1-283 + 284-331 + 403-450 + 488-604) | SEQ ID NO: 218 | SEQ ID NO: 217 |
| 1a + 2a + 2b + 3 (49-283 + 284-331 + 341-396 + 488-604) | SEQ ID NO: 220 | SEQ ID NO: 219 |
| 1a + 2b + 2c + 3 (49-283 + 341-396 + 403-450 + 488-604) | SEQ ID NO: 222 | SEQ ID NO: 221 |
| 1a + 2a + 2c + 3 (49-283 + 284-331 + 403-450 + 488-604) | SEQ ID NO: 224 | SEQ ID NO: 223 |
| 1 + 2a + 2b + 2c + 3 (1-283 + 284-331 + 341-396 + 403-450 + 488-604) | SEQ ID NO: 226 | SEQ ID NO: 225 |
| 1a + 2a + 2b + 2c + 3 (49-283 + 284-331 + 341-396 + 403-450 + 488-604) | SEQ ID NO: 228 | SEQ ID NO: 227 |
| 1 without signal peptide (25-283) | SEQ ID NO: 230 | SEQ ID NO: 229 |
| 1 + 2 without signal peptide (25-487) | SEQ ID NO: 232 | SEQ ID NO: 231 |
| 1 + 3 without signal peptide (25-283 + 488-604) | SEQ ID NO: 234 | SEQ ID NO: 233 |
| 1 + 2a without signal peptide (25-283 + 284-331) | SEQ ID NO: 236 | SEQ ID NO: 235 |
| 1 + 2b without signal peptide (25-283 + 341-396) | SEQ ID NO: 238 | SEQ ID NO: 237 |
| 1 + 2c without signal peptide (25-283 + 403-450) | SEQ ID NO: 240 | SEQ ID NO: 239 |
| 1 + 2a + 2b without signal peptide (25-283 + 284-331 + 341-396) | SEQ ID NO: 242 | SEQ ID NO: 241 |
| 1 + 2b + 2c without signal peptide (25-283 + 341-396 + 403-450) | SEQ ID NO: 244 | SEQ ID NO: 243 |
| 1 + 2a + 2c without signal peptide (25-283 + 284-331 + 403-450) | SEQ ID NO: 246 | SEQ ID NO: 245 |
| 1 + 2a + 2b + 2c without signal peptide (25-283 + 284-331 + 341-396 + 403-450) | SEQ ID NO: 248 | SEQ ID NO: 247 |
| 1 + 2a + 3 without signal peptide (25-283 + 284-331 + 488-604) | SEQ ID NO: 250 | SEQ ID NO: 249 |
| 1 + 2b + 3 without signal peptide (25-283 + 341-396 + 488-604) | SEQ ID NO: 252 | SEQ ID NO: 251 |
| 1 + 2c + 3 without signal peptide (25-283 + 403-450 + 488-604) | SEQ ID NO: 254 | SEQ ID NO: 253 |
| 1 + 2a + 2b + 3 without signal peptide (25-283 + 284-331 + 341-396 + 488-604) | SEQ ID NO: 256 | SEQ ID NO: 255 |
| 1 + 2b + 2c + 3 without signal peptide (25-283 + 341-396 + 403-450 + 488-604) | SEQ ID NO: 258 | SEQ ID NO: 257 |
| 1 + 2a + 2c + 3 without signal peptide (25-283 + 284-331 + 403-450 + 488-604) | SEQ ID NO: 260 | SEQ ID NO: 259 |
| 1 + 2a + 2b + 2c + 3 without signal peptide (25-283 + 284-331 + 341-396 + 403-450 + 488-604) | SEQ ID NO: 262 | SEQ ID NO: 261 |
| Fragments of netrin G1 | | |
| 1 (1-295) | SEQ ID NO: 264 | SEQ ID NO: 263 |
| 2 (296-438) | SEQ ID NO: 266 | SEQ ID NO: 265 |
| 1a (71-295) | SEQ ID NO: 268 | SEQ ID NO: 267 |
| 2a (296-342) | SEQ ID NO: 270 | SEQ ID NO: 269 |
| 2b (373-409) | SEQ ID NO: 272 | SEQ ID NO: 271 |
| 1 + 2a (1-295 + 296-342) | SEQ ID NO: 274 | SEQ ID NO: 273 |
| 1 + 2b (1-295 + 373-409) | SEQ ID NO: 276 | SEQ ID NO: 275 |
| 1 + 2a + 2b (1-295 + 296-342 + 373-409) | SEQ ID NO: 278 | SEQ ID NO: 277 |
| 1a + 2 (71-295 + 296-438) | SEQ ID NO: 280 | SEQ ID NO: 279 |
| 1a + 2a (71-295 + 296-342) | SEQ ID NO: 282 | SEQ ID NO: 281 |
| 1a + 2b (71-295 + 373-409) | SEQ ID NO: 284 | SEQ ID NO: 283 |
| 2a + 2b (296-342 + 373-409) | SEQ ID NO: 286 | SEQ ID NO: 285 |
| 1a + 2a + 2b (71-295 + 296-342 + 373-409) | SEQ ID NO: 288 | SEQ ID NO: 287 |
| 1 without signal peptide (29-295) | SEQ ID NO: 290 | SEQ ID NO: 289 |
| 1 + 2a without signal peptide (29-295 + 296-342) | SEQ ID NO: 292 | SEQ ID NO: 291 |
| 1 + 2b without signal peptide (29-295 + 373-409) | SEQ ID NO: 294 | SEQ ID NO: 293 |
| 1 + 2a + 2b without signal peptide (29-295 + 296-342 + 373-409) | SEQ ID NO: 296 | SEQ ID NO: 295 |
| Fragments of netrin 3 | | |
| 1 (1-253) | SEQ ID NO: 298 | SEQ ID NO: 297 |
| 1a (34-253) | SEQ ID NO: 300 | SEQ ID NO: 299 |
| 2 (254-433) | SEQ ID NO: 302 | SEQ ID NO: 301 |
| 2a (254-299) | SEQ ID NO: 304 | SEQ ID NO: 303 |
| 2b (373-422) | SEQ ID NO: 306 | SEQ ID NO: 305 |
| 3 (433-580) | SEQ ID NO: 308 | SEQ ID NO: 307 |
| 1 + 2 (1-422) | SEQ ID NO: 310 | SEQ ID NO: 309 |
| 2 + 3 (254-433) | SEQ ID NO: 312 | SEQ ID NO: 311 |
| 1 + 3 (1-253 + 433-580) | SEQ ID NO: 314 | SEQ ID NO: 313 |
| 1 + 2a (1-299) | SEQ ID NO: 316 | SEQ ID NO: 315 |
| 1 + 2b (1-253 + 373-422) | SEQ ID NO: 318 | SEQ ID NO: 317 |
| 1 + 2a + 2b (1-253 + 254-299 + 373-422) | SEQ ID NO: 320 | SEQ ID NO: 319 |
| 2a + 3 (254-299 + 433-580) | SEQ ID NO: 322 | SEQ ID NO: 321 |

|  | Protein sequence | Nucleotide sequence |
|---|---|---|
| 2b + 3 (373-422 + 433-580) | SEQ ID NO: 324 | SEQ ID NO: 323 |
| 2a + 2b (254-299 + 373-422) | SEQ ID NO: 326 | SEQ ID NO: 325 |
| 2a + 2b + 3 (254-299 + 373-422 + 433-580) | SEQ ID NO: 328 | SEQ ID NO: 327 |
| 1 + 2a + 3 (1-253 + 254-299 + 433-580) | SEQ ID NO: 330 | SEQ ID NO: 329 |
| 1 + 2b + 3 (1-253 + 373-422 + 433-580) | SEQ ID NO: 332 | SEQ ID NO: 331 |
| 1 + 2a + 2b + 3 (1-253 + 254-299 + 373-422 + 433-580) | SEQ ID NO: 334 | SEQ ID NO: 333 |
| 1a + 2 (34-253 + 254-433) | SEQ ID NO: 336 | SEQ ID NO: 335 |
| 1a + 3 (34-253 + 433-580) | SEQ ID NO: 338 | SEQ ID NO: 337 |
| 1a + 2a (34-253 + 254-299) | SEQ ID NO: 340 | SEQ ID NO: 339 |
| 1a + 2b (34-253 + 373-422) | SEQ ID NO: 342 | SEQ ID NO: 341 |
| 1a + 2 + 3 34-253 + 254-433 + 433-580) | SEQ ID NO: 344 | SEQ ID NO: 343 |
| 1a + 2a + 2b (34-253 + 254-299 + 373-422) | SEQ ID NO: 346 | SEQ ID NO: 345 |
| 1a + 2a + 3 (34-253 + 254-299 + 433-580) | SEQ ID NO: 348 | SEQ ID NO: 347 |
| 1a + 2b + 3 (34-253 + 373-422 + 433-580) | SEQ ID NO: 350 | SEQ ID NO: 349 |
| 1a + 2a + 2b + 3 (34-253 + 254-299 + 373-422 + 433-580) | SEQ ID NO: 352 | SEQ ID NO: 351 |
| Fragments of RGM | | |
| RGMA (180-290) | SEQ ID NO: 354 | SEQ ID NO: 353 |
| RGMB (180-290) | SEQ ID NO: 356 | SEQ ID NO: 355 |
| RGMC (180-290) | SEQ ID NO: 358 | SEQ ID NO: 357 |
| Fragments of mutated netrin 4 | | |
| 1 (1-260) | SEQ ID NO: 374 | SEQ ID NO: 373 |
| 2 (261-515) | SEQ ID NO: 376 | SEQ ID NO: 375 |
| 1 + 2 (1-515) | SEQ ID NO: 378 | SEQ ID NO: 377 |
| 1a + 2 (32-515) | SEQ ID NO: 380 | SEQ ID NO: 379 |
| 1a + 2 + 3 (32-628) | SEQ ID NO: 382 | SEQ ID NO: 381 |
| 2b (332-387) | SEQ ID NO: 384 | SEQ ID NO: 383 |
| 1a (32-260) | SEQ ID NO: 386 | SEQ ID NO: 385 |
| 1 + 3 (1-260 + 516-628) | SEQ ID NO: 388 | SEQ ID NO: 387 |
| 2 + 3 (261-628) | SEQ ID NO: 390 | SEQ ID NO: 389 |
| 1 + 2a (1-260 + 261-320) | SEQ ID NO: 392 | SEQ ID NO: 391 |
| 1 + 2b (1-260 + 332-387) | SEQ ID NO: 394 | SEQ ID NO: 393 |
| 1 + 2c (1-260 + 394-445) | SEQ ID NO: 396 | SEQ ID NO: 395 |
| 1a + 2a (32-260 + 261-320) | SEQ ID NO: 398 | SEQ ID NO: 397 |
| 1a + 2b (32-260 + 332-387) | SEQ ID NO: 400 | SEQ ID NO: 399 |
| 1a + 2c (32-260 + 394-445) | SEQ ID NO: 402 | SEQ ID NO: 401 |
| 2a + 2b (261-320 + 332-387) | SEQ ID NO: 404 | SEQ ID NO: 403 |
| 2b + 2c (332-387 + 394-445) | SEQ ID NO: 406 | SEQ ID NO: 405 |
| 2a + 2b + 2c (261-320 + 332-387 + 394-445) | SEQ ID NO: 408 | SEQ ID NO: 407 |
| 1 + 2a + 2b (1-260 + 261-320 + 332-387) | SEQ ID NO: 410 | SEQ ID NO: 409 |
| 1 + 2b + 2c (1-260 + 332-387 + 394-445) | SEQ ID NO: 412 | SEQ ID NO: 411 |
| 1 + 2a + 2c (1-260 + 261-320 + 394-445) | SEQ ID NO: 414 | SEQ ID NO: 413 |
| 1a + 2a + 2b (32-260 + 261-320 + 332-387) | SEQ ID NO: 416 | SEQ ID NO: 415 |
| 1a + 2b + 2c (32-260 + 332-387 + 394-445) | SEQ ID NO: 418 | SEQ ID NO: 417 |
| 1a + 2a + 2c (32-260 + 261-320 + 394-445) | SEQ ID NO: 420 | SEQ ID NO: 419 |
| 1 + 2a + 2b + 2c (1-260 + 261-320 + 332-387 + 394-445) | SEQ ID NO: 422 | SEQ ID NO: 421 |
| 1a + 2a + 2b + 2c (32-260 + 261-320 + 332-387 + 394-445) | SEQ ID NO: 424 | SEQ ID NO: 423 |
| 2b + 3 (332-387 + 516-628) | SEQ ID NO: 426 | SEQ ID NO: 425 |
| 1a + 3 (32-260 + 516-628) | SEQ ID NO: 428 | SEQ ID NO: 427 |
| 1a + 2a + 3 (32-260 + 261-320 + 516-628) | SEQ ID NO: 430 | SEQ ID NO: 429 |
| 1a + 2b + 3 (32-260 + 332-387 + 516-628) | SEQ ID NO: 432 | SEQ ID NO: 431 |
| 1a + 2c + 3 (32-260 + 394-445 + 516-628) | SEQ ID NO: 434 | SEQ ID NO: 433 |
| 1 + 2a + 3 (1-260 + 261-320 + 516-628) | SEQ ID NO: 436 | SEQ ID NO: 435 |
| 1 + 2b + 3 (1-260 + 332-387 + 516-628) | SEQ ID NO: 438 | SEQ ID NO: 437 |
| 1 + 2c + 3 (1-260 + 394-445 + 516-628) | SEQ ID NO: 440 | SEQ ID NO: 439 |
| 2a + 2b + 3 (261-320 + 332-387 + 516-628) | SEQ ID NO: 442 | SEQ ID NO: 441 |
| 2b + 2c + 3 (332-387 + 394-445 + 516-628) | SEQ ID NO: 444 | SEQ ID NO: 443 |
| 2a + 2b + 2c + 3 (261-320 + 332-387 + 394-445 + 516-628) | SEQ ID NO: 446 | SEQ ID NO: 445 |
| 1 + 2a + 2b + 3 (1-260 + 261-320 + 332-387 + 516-628) | SEQ ID NO: 448 | SEQ ID NO: 447 |
| 1 + 2b + 2c + 3 (1-260 + 332-387 + 394-445 + 516-628) | SEQ ID NO: 450 | SEQ ID NO: 449 |
| 1 + 2a + 2c + 3 (1-260 + 261-320 + 394-445 + 516-628) | SEQ ID NO: 452 | SEQ ID NO: 451 |
| 1a + 2a + 2b + 3 (32-260 + 261-320 + 332-387 + 516-628) | SEQ ID NO: 454 | SEQ ID NO: 453 |
| 1a + 2b + 2c + 3 (32-260 + 332-387 + 394-445 + 516-628) | SEQ ID NO: 456 | SEQ ID NO: 455 |
| 1a + 2a + 2c + 3 (32-260 + 261-320 + 394-445 + 516-628) | SEQ ID NO: 458 | SEQ ID NO: 457 |
| 1 + 2a + 2b + 2c + 3 (1-260 + 261-320 + 332-387 + 394-445 + 516-628) | SEQ ID NO: 460 | SEQ ID NO: 459 |
| 1a + 2a + 2b + 2c + 3 (32-260 + 261-320 + 332-387 + 394-445 + 516-628) | SEQ ID NO: 462 | SEQ ID NO: 461 |
| 1 without signal peptide (20-260) | SEQ ID NO: 464 | SEQ ID NO: 463 |
| 1 + 2 without signal peptide (20-516) | SEQ ID NO: 466 | SEQ ID NO: 465 |
| 1 + 3 without signal peptide (20-260 + 516-628) | SEQ ID NO: 468 | SEQ ID NO: 467 |
| 1 + 2a without signal peptide (20-260 + 261-320) | SEQ ID NO: 470 | SEQ ID NO: 469 |
| 1 + 2b without signal peptide (20-260 + 332-387) | SEQ ID NO: 472 | SEQ ID NO: 471 |
| 1 + 2c without signal peptide (20-260 + 394-445) | SEQ ID NO: 474 | SEQ ID NO: 473 |
| 1 + 2a + 2b without signal peptide (20-260 + 261-320 + 332-387) | SEQ ID NO: 476 | SEQ ID NO: 475 |
| 1 + 2b + 2c without signal peptide (20-260 + 332-387 + 394-445) | SEQ ID NO: 478 | SEQ ID NO: 477 |
| 1 + 2a + 2c without signal peptide (20-260 + 261-320 + 394-445) | SEQ ID NO: 480 | SEQ ID NO: 479 |
| 1 + 2a + 2b + 2c without signal peptide (20-260 + 261-320 + 332-387 + 394-445) | SEQ ID NO: 482 | SEQ ID NO: 481 |
| 1 + 2a + 3 without signal peptide (20-260 + 261-320 + 516-628) | SEQ ID NO: 484 | SEQ ID NO: 483 |

| | Protein sequence | Nucleotide sequence |
|---|---|---|
| 1 + 2b + 3 without signal peptide (20-260 + 332-387 + 516-628) | SEQ ID NO: 486 | SEQ ID NO: 485 |
| 1 + 2c + 3 without signal peptide (20-260 + 394-445 + 516-628) | SEQ ID NO: 488 | SEQ ID NO: 487 |
| 1 + 2a + 2b + 3 without signal peptide (20-260 + 261-320 + 332-387 + 516-628) | SEQ ID NO: 490 | SEQ ID NO: 489 |
| 1 + 2b + 2c + 3 without signal peptide (20-260 + 332-387 + 394-445 + 516-628) | SEQ ID NO: 492 | SEQ ID NO: 491 |
| 1 + 2a + 2c + 3 without signal peptide (20-260 + 261-320 + 394-445 + 516-628) | SEQ ID NO: 494 | SEQ ID NO: 493 |
| 1 + 2a + 2b + 2c + 3 without signal peptide (20-260 + 261-320 + 332-387 + 394-445 + 516-628) | SEQ ID NO: 496 | SEQ ID NO: 495 |

EXPERIMENTAL PART

FIG. 1 corresponds to the HUAEC cell migration test. The cells are counted in 8 fields and the average and the standard deviation are represented on the y-axis. The x-axis corresponds to the concentration of the netrin 4 protein in ng/ml in the presence (V 50) or absence of 50 ng/ml of VEGF (vascular endothelial growth factor).

Figure 2:
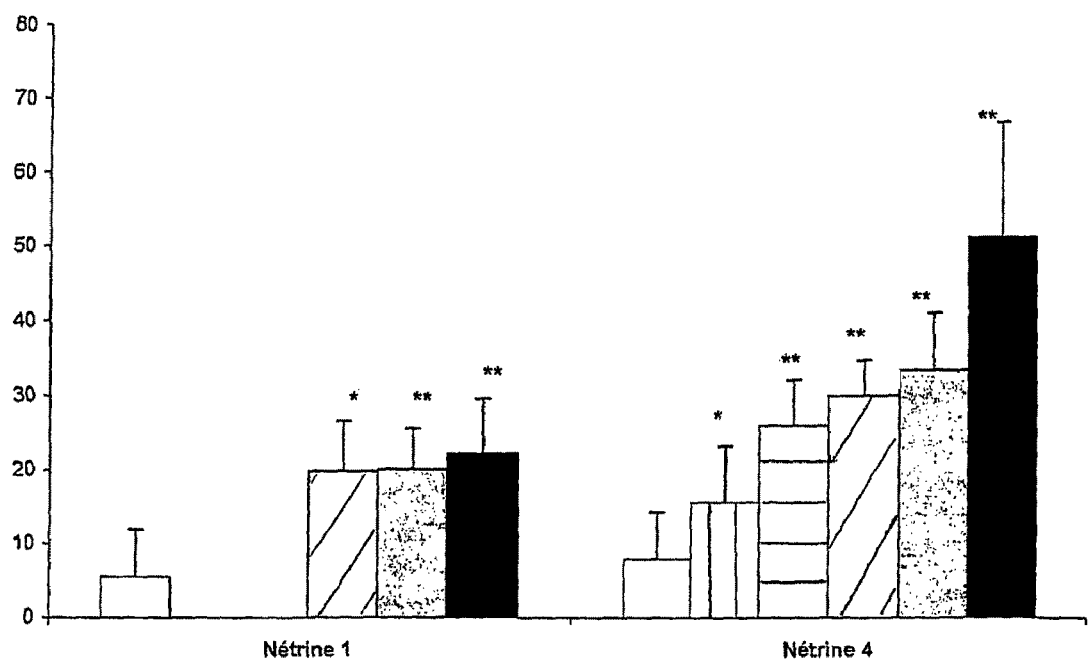

FIG. 2 corresponds to the aorta smooth muscle cell migration test. The cells are counted in 8 fields and the average and the standard deviation are represented on the y-axis. The x-axis corresponds to the concentration of the netrin 1 and netrin 4 proteins in ng/ml. The white columns correspond to a concentration of 0 ng/ml; the columns with vertical hatching correspond to a concentration of 6 ng/ml; the columns with horizontal hatching correspond to a concentration of 18 ng/ml; the columns with oblique hatching correspond to a concentration of 55 ng/ml; the grey columns correspond to a concentration of 160 ng/ml and the black columns correspond to a concentration of 500 ng/ml.

Figure 3:
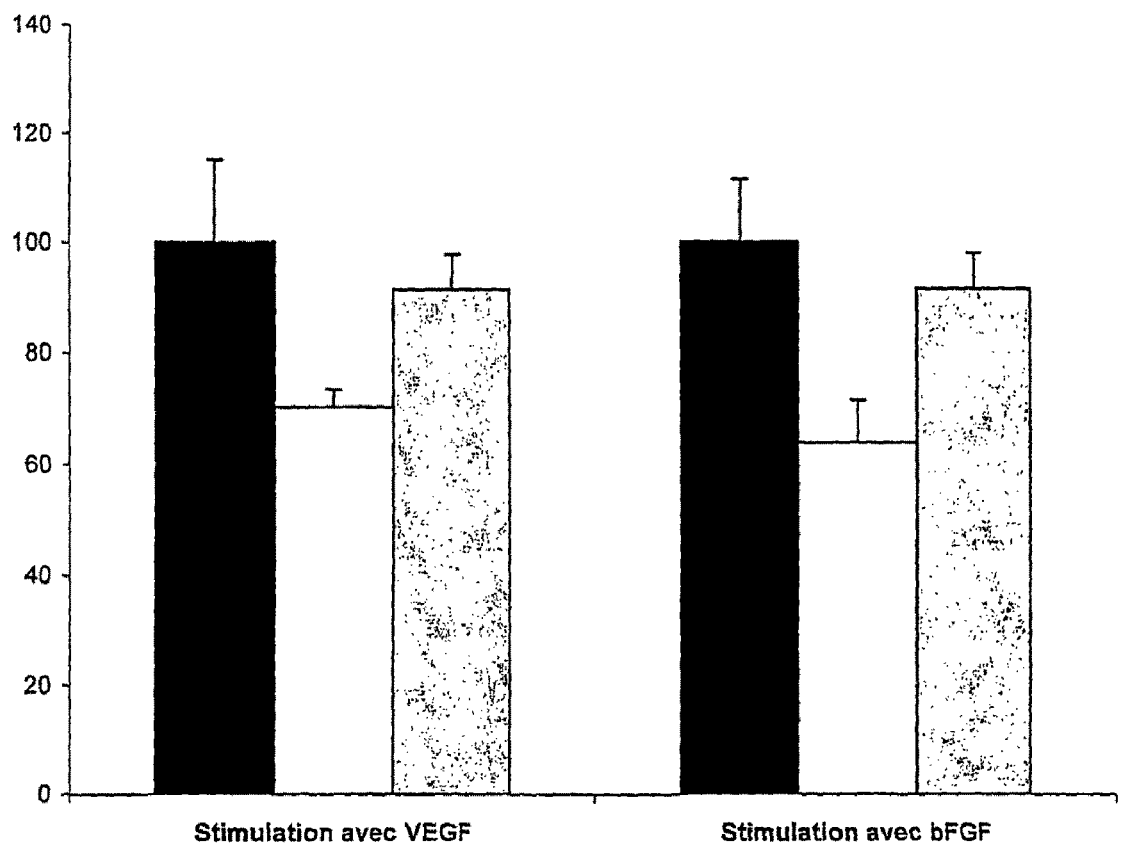

FIG. 3 corresponds to the HUAEC cell proliferation test. The x-axis corresponds to the concentration of the netrin 4 protein (500 ng/ml) in the presence of 2 ng/ml of VEGF or FGF2 as indicated in the figure and the y-axis to the percentage of proliferation. The black columns correspond to the control; the white columns correspond to the percentage of proliferation in the presence of 500 ng/ml of netrin 4 and the grey columns correspond to the percentage of proliferation in the presence of 500 ng/ml of netrin 4 and 5 µg/ml of IgG directed against the neogenin receptor.

Figure 4:
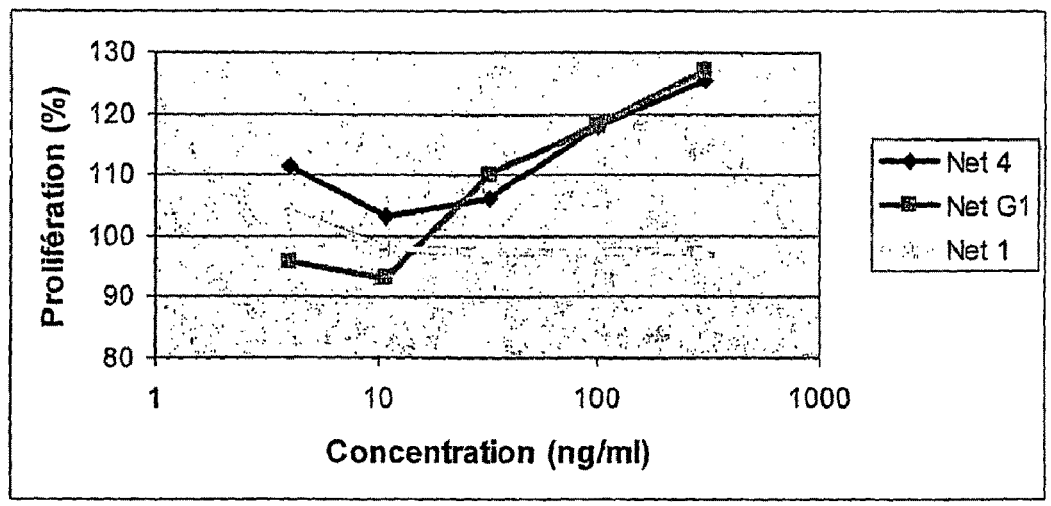

FIG. 4 corresponds to the analysis of the effect of netrin 4 (NET-4), netrin 1 (NET-1) and netrin G1 (NET-G1) on VSM proliferation. The curve represented by diamonds corresponds to netrin 4. The curve represented by squares corresponds to netrin G1. The curve represented by triangles corresponds to netrin 1.

Figure 5:
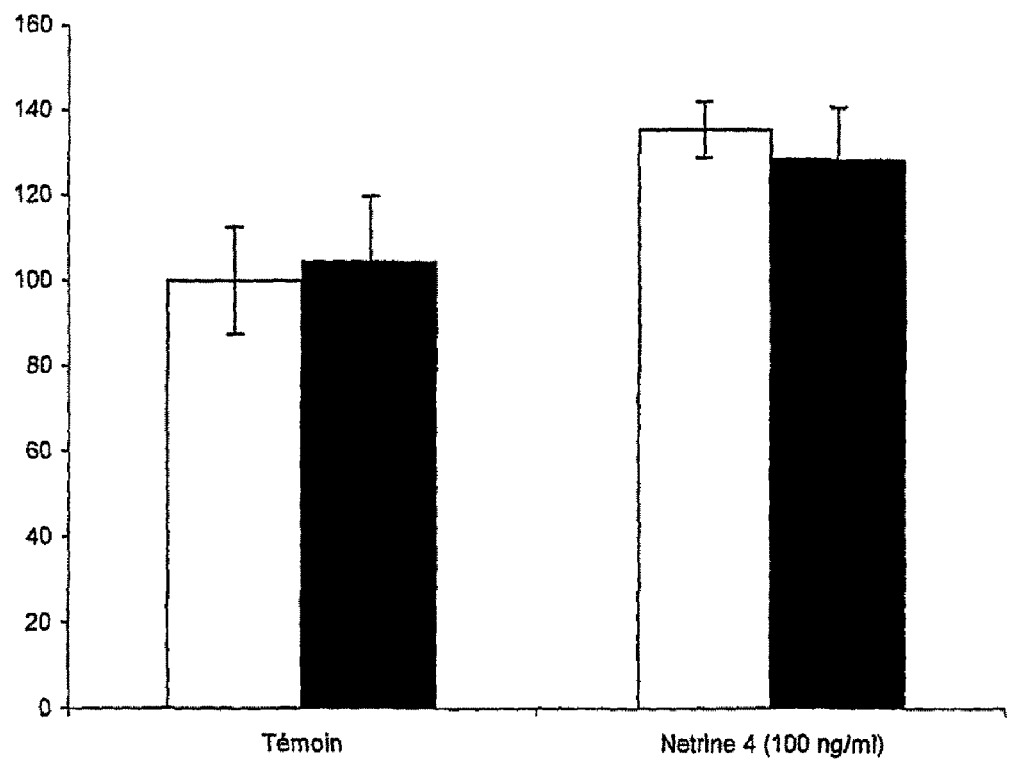

FIG. 5 represents the effect of an anti-neogenin antibody on VSM proliferation. The y-axis represents the optical density at 595 nm. The white columns correspond to proliferation without anti-neogenin antibodies and the black columns correspond to proliferation in the presence of 5 µg/ml of anti-neogenin antibodies.

Figure 6:
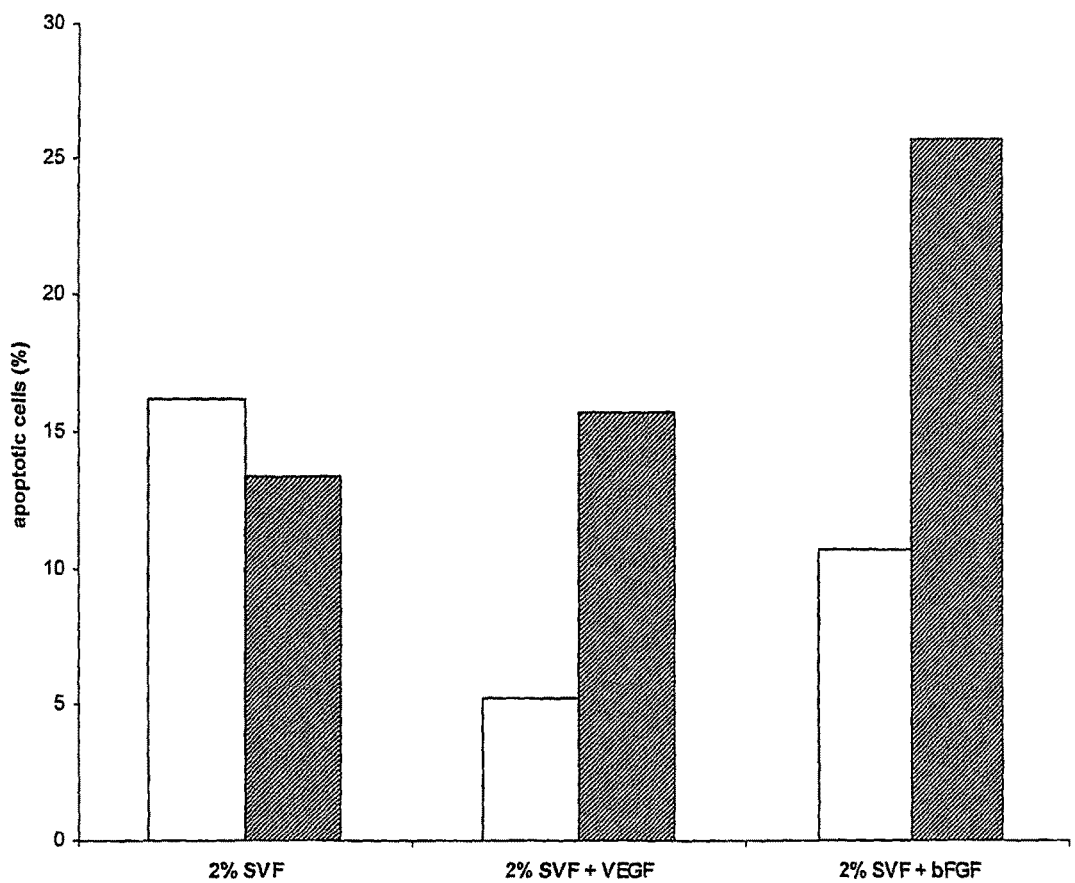

FIG. 6 corresponds to the HUAEC cell apoptosis test. The x-axis corresponds to the concentration of the netrin 4 protein (500 ng/ml) in the presence of 50 ng/ml of VEGF or FGF2 as indicated in the figure and the y-axis to the percentage of apoptotic cells. The white columns correspond to the control without netrin 4; the grey columns correspond to the percentage of apoptosis in the presence of 500 ng/ml of netrin 4.

Figure 7:
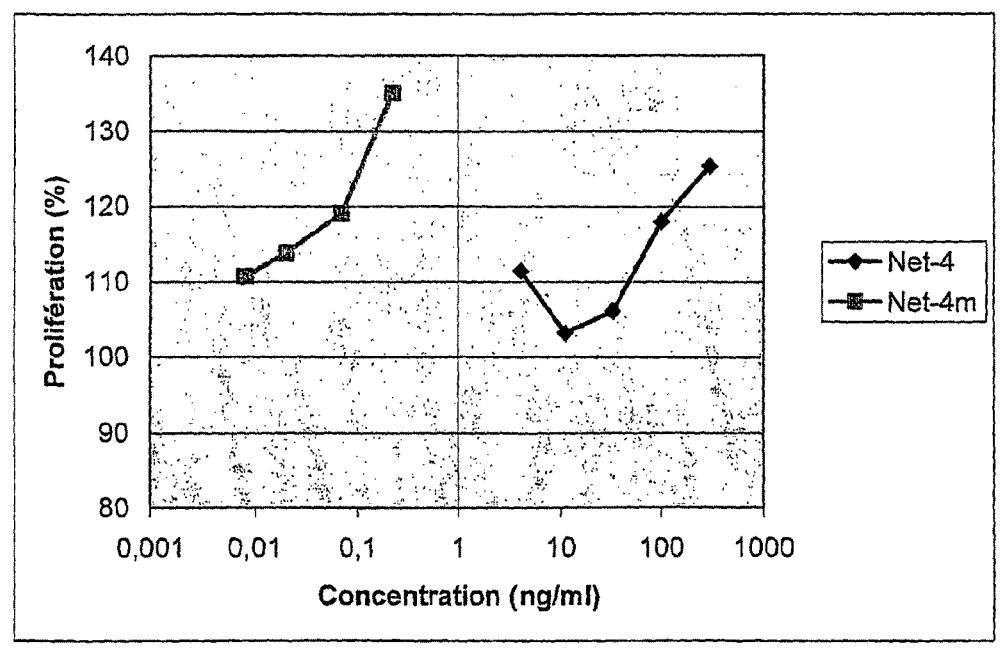
Figure 7:
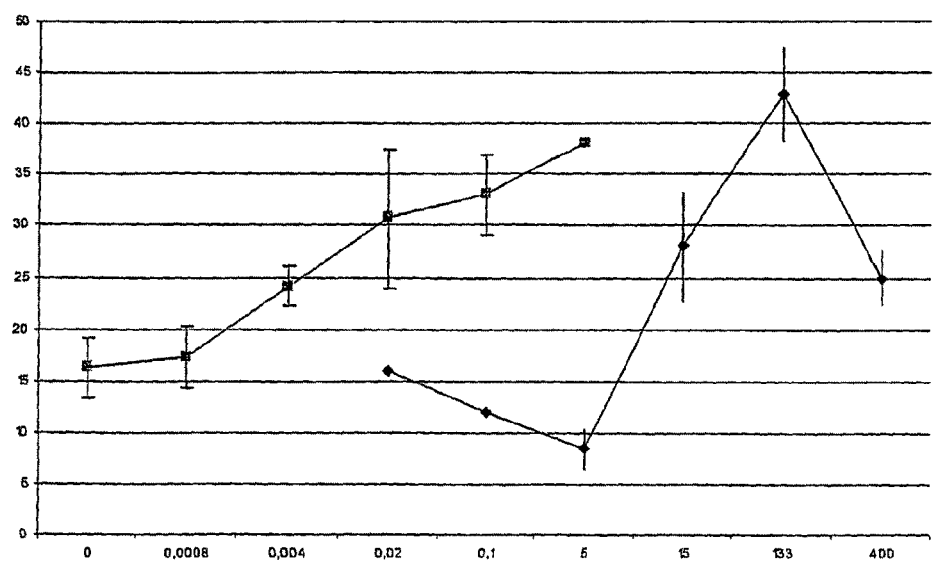

FIG. 7 A corresponds to the aorta smooth muscle cell proliferation test. The x-axis corresponds to the concentration in ng/ml of netrin 4 protein or of mutated netrin 4 protein and the y-axis to the percentage of proliferation. The left curve represented by squares corresponds to mutated netrin 4. The right curve represented by diamonds corresponds to netrin 4.

FIG. 7 B corresponds to the aorta smooth muscle cell migration test. The cells are counted in 8 fields and the average and the standard deviation are represented on the y-axis. The x-axis corresponds to the concentration of netrin 4 and mutated netrin 4 proteins in ng/ml. The curve represented by squares corresponds to mutated netrin 4. The curve represented by diamonds corresponds to netrin 4.

Figure 8:
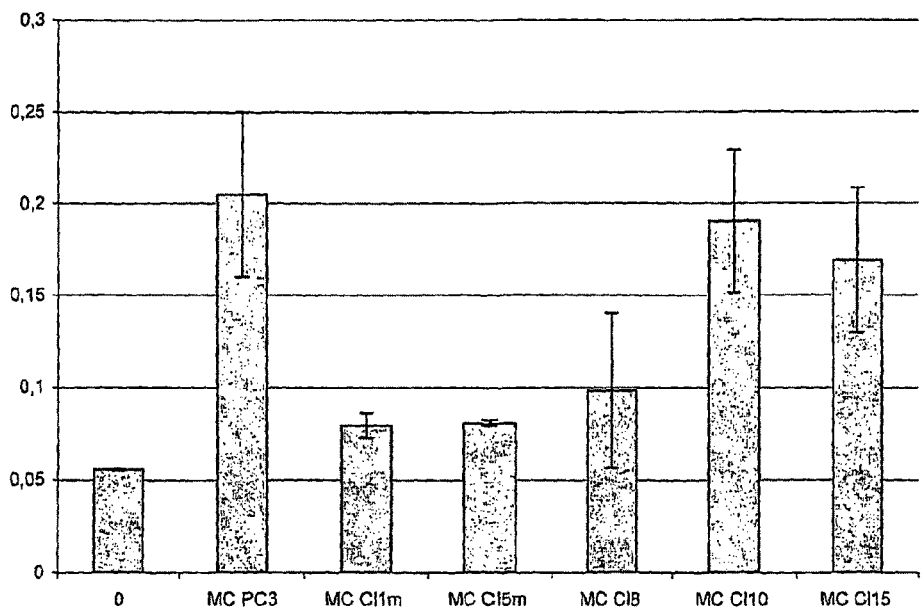

FIG. 8 corresponds to an HUAEC cell proliferation test in order to determine the effect of the supernatants of PC3 cells transfected with mutated (clone 1 and clone 5) or non-mutated (clone 8, 10 and 15) netrin 4. The y-axis represents the percentage of proliferation. Column 1 corresponds to the control (DMEM alone); column 2 corresponds to non-transfected PC3 cells; column 3 corresponds to clone 1; column 4 corresponds to clone 5; column 5 corresponds to clone 8; column 6 corresponds to clone 10; column 7 corresponds to clone 15.

Figure 9:
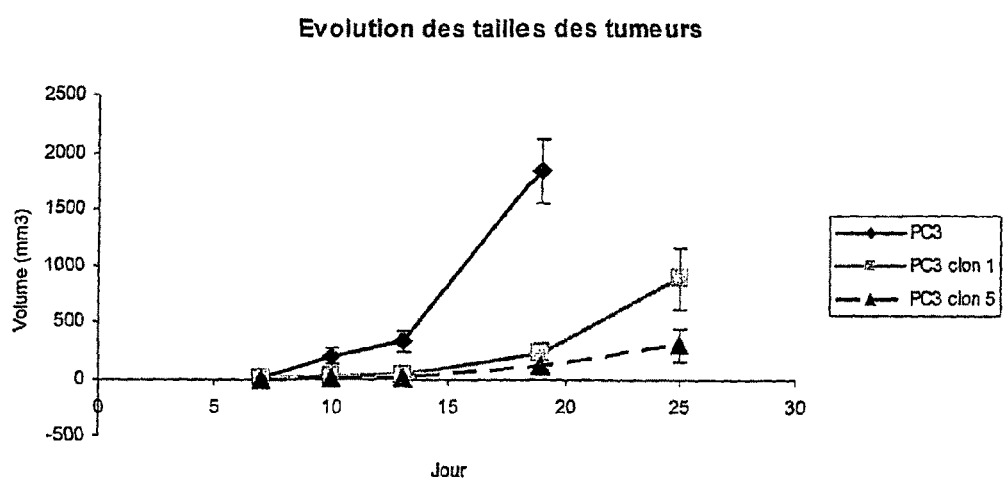

FIG. 9 corresponds to analysis of the tumor progression. The x-axis corresponds to the time expressed in days, d=0 being the day when the tumor graft is carried out. The y-axis corresponds to the volume of the tumors (in $mm^3$). The curve comprising the diamonds corresponds to non-transfected PC3 cells. The curve comprising the squares corresponds to PC3 cells transfected with clone 1. The curve comprising the triangles corresponds to PC3 cells transfected with clone 5.

Figure 10:
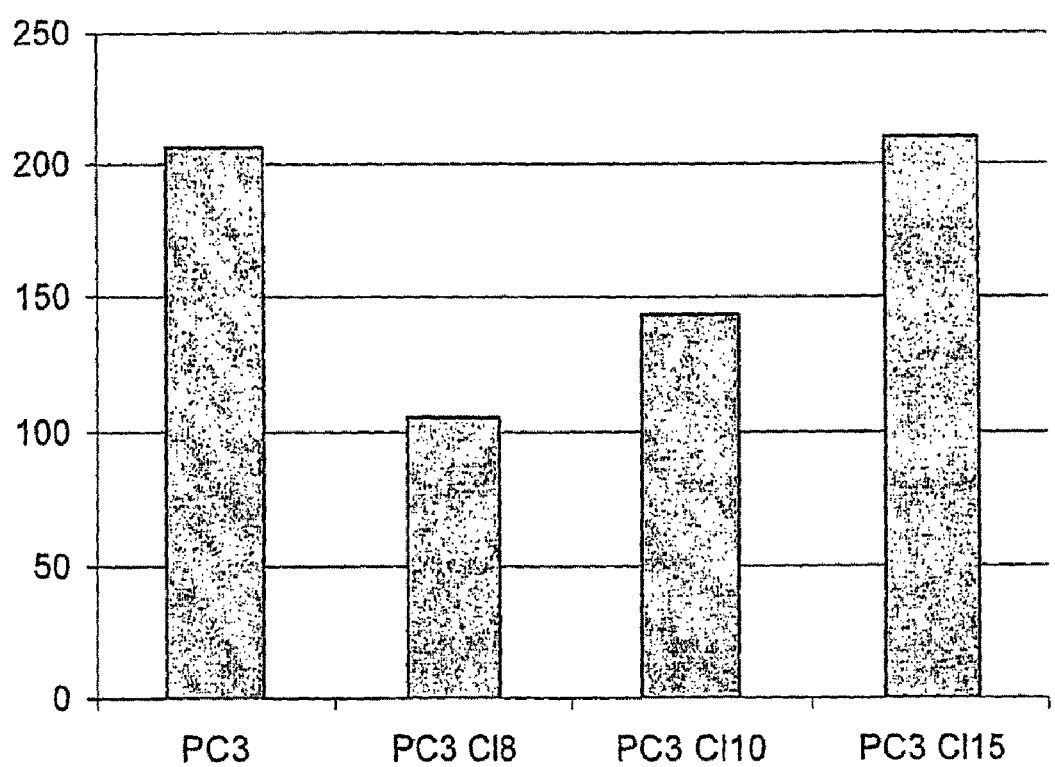

FIG. 10 corresponds to analysis of the tumor progression in the presence of AVASTIN. The y-axis corresponds to the ratio of the tumor volume measured after the treatment to the tumor volume measured before the treatment. Column 1 corresponds to the non-transfected PC3 cells; column 2 corresponds to PC3 clone 8; column 3 corresponds to PC3 clone 10; column 4 corresponds to PC3 clone 15.

FIGS. 11 A and 11 B correspond to analysis of the effect of netrin 4 on choroid vascularization in mice. In FIG. 11 A, the mice have received an injection of 1 µl of PBS. In FIG. 11 B, the mice have received an injection of 1 µl of PBS containing 1 µg of netrin 4. The endothelial cells are shown by immunolabelling and appear in white in FIGS. 11 A and 11 B.

FIGS. 12 A, 12 B, 12 C correspond to the perfusion of a fluorescent dextran which visualizes the choroid neovessels around a laser impact in grey at the centre. The rats received two or three laser impacts on D (days)=0, then on D=7, D=10 a sub-retinal injection of the vehicle alone (PBS) (12 A) or containing netrin 1 (12 B) or 2 µg of netrin 4 (12 C) or 100 pg of mutated netrin 4 (12 D). On D=14, the rats are sacrificed and perfused with fluorescent lectin which makes it possible to visualize the choroid neovessels appearing in white on the figures and surrounding an laser impact in grey.

Figure 13:
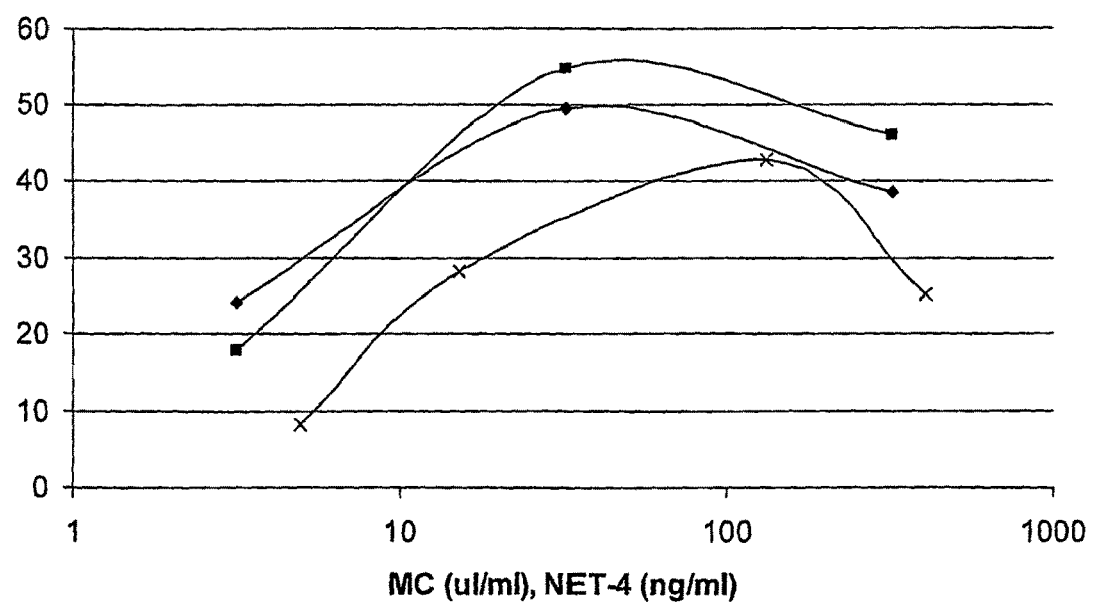

FIG. 13 corresponds to the aorta smooth muscle cells migration test in the presence of deletion mutants of mutated netrin 4. The cells are counted in 8 fields and the average and the standard deviation are represented on the y-axis. The x-axis corresponds to the concentration of netrin 4 in ng/ml. The curve with the crosses corresponds to non-mutated netrin 4. The curve with the diamonds corresponds to the conditioned medium of the cells transfected with a complete sequence of mutated netrin 4. The curve with the squares corresponds to the conditioned medium of the cells transfected with the sequence SEQ ID NO: 528.

EXPERIMENTAL PART

Materials

The netrin 1 (SEQ ID NO: 502), netrin 4 (SEQ ID NO: 498), netrin G1 (SEQ ID NO: 506), netrin 3 (SEQ ID NO: 510) and mutated netrin 4 (SEQ ID NO: 522) molecules are recombinant proteins. The netrin 1, netrin 4 and netrin G1 molecules are commercially available from R&D.

The VEGF isoform with 165 amino acids is produced by infection of SF9 insect cells by a recombinant baculovirus containing the corresponding cDNA (Plouët et al., 1997).

Human umbilical arterial endothelial cells (HUAEC) were isolated from umbilical arteries perfused with collagenase (Sigma) in order to digest the basal membrane. The HUAEC cells were maintained in EBM medium (Clonetics) with 15% of heat-inactivated foetal calf serum (FCS), 100 µg/ml of penicillin and 100 µg/ml of streptomycin added at 37° C. in 10% $CO_2$. The stem cultures received 2 ng/ml of VEGF every second day.

Aorta smooth muscle cells were maintained in DMEM medium with 15% of heat-inactivated foetal calf serum (FCS), 100 µg/ml of penicillin and 100 µg/ml of streptomycin added to 37° C. in 10% $CO_2$. The stem cultures received 2 ng/ml of VEGF every second day.

Identification of a Mutated Netrin 4

Cloning of Mutated Netrin 4

The total RNAs of the cells of the human umbilical cord artery (HUAEC) were extracted using TriPure (Roche). Then the RNAs were transcribed using Roche's RT-PCR (AMV) kit according to the manufacturer's instructions.

The primers (5')-TT CTA GAC ATG GGG AGC TGC GCG CGG-(3') (SEQ ID NO: 529) (sense) and (5')-C ATT AAC GTC GAA CTG ACA GGT ATC-(3') (SEQ ID NO: 530) (anti-sense) served for the amplification of the sequence 1-1039 of netrin 4, whilst the primers (5')-AG CAC TGT GCC CCG TTA TAC AAT GA-(3') (SEQ ID NO: 531) (sense) and (5')-CGG GAT CCA CTT GCA CTC TCT TTT TAA AAT ATC C-(3') (SEQ ID NO: 532) (anti-sense) were used in order to amplify the sequence 914-1884 of netrin 4.

The conditions adopted for the amplification were: 35 cycles with denaturation at 94° C. for 1 minute; hybridization at 55° C. for 1 minute; and extension at 72° C. for 1 minute.

The products obtained were mixed and used in order to carry out a new PCR with the primers (5')-TT CTA GAC ATG GGG AGC TGC GCG CGG-(3') (SEQ ID NO: 529) (sense) and (5')-CGG GAT CCA CTT GCA CTC TCT TTT TAA AAT ATC C-(3') (SEQ ID NO: 532) (anti-sense) under the same conditions described previously, with a number of cycles of 25 instead of 35. This PCR product containing the whole sequence of netrin 4 was cloned in the intermediate vector pCR2.1 (Invitrogen). After digestion by Xba I and Bam HI, the sequence of netrin 4 was extracted from this vector and inserted into the vector pCDNA3.1 (−)/His myc C digested by the same restriction enzymes. This last vector containing the complete sequence of mutated netrin 4 was used in order to transfect cells. An identical manipulation led to the obtaining of an expression vector of wild-type netrin 4 using the wild-type netrin 4 sequence.

Mutated netrin 4 was produced by transfection of CHO pgsA 745 cells by the vector containing the wild-type netrin 4 sequence according to a protocol already described (Plouët, 1997). The protein was purified by heparin-sepharose affinity chromatography and eluted by a discontinuous gradient of NaCl (0, 3; 1.0 and 2.0 M NaCl. NET 4m is eluted by NaCl 2M, and has a degree of purity >90%.

The biological activity of mutated netrin 4 (NET 4m) was compared to that of wild-type netrin 4 (NET 4) according to the smooth muscle cell proliferation test. FIG. 7A shows that the NET 4 m triggers mitogenic activity at a concentration 1000 times less than that of NET 4. Similarly in a migration test, NET-4 m is 1000 times more active than NET-4 (See FIG. 7B).

Construction of Deletion Mutants for Mutated Netrin 4

The vector pcDNA3.1 (−)/His myc C containing the complete sequence of mutated netrin 4 (628 AA) was digested by the restriction enzyme BamH1, treated with the klenow fragment of polymerase 1, then digested with the restriction enzyme PshA1. The linearized fragment corresponding to the vector pcDNA3.1 (−)/His myc C containing the mutated netrin 4 sequence deleted from the cter domain (478-628) is then isolated after agarose gel migration and purified on a Qiagen column. After ligation, a pcDNA3.1 (−)/His myc C expression vector containing the sequence of mutated netrin 4 deleted from the cter domain (1-477) is therefore obtained. The pcDNA3.1 (−)/His myc C vector containing the complete sequence of mutated netrin 4 (628 aa) was digested by the Xcm1 restriction enzyme. This enzyme which cleaves the internal sequence of netrin 4 in two sites (aa288/aa488) makes it possible to delete the protein from its central domain (V domain with EGF units). After purification of the fragment and ligation, a pcDNA3.1 (−)/His myc C expression vector containing the mutated netrin 4 sequence deleted from the central domain (288/488) is therefore obtained. However, since the ligation of the two Xcm1 sites leads to the appearance of a stop codon (aa 313), this vector codes for a truncated mutated netrin 4 protein with 312 amino acids comprising the sequence of the laminin domain (1-288) and a protein sequence of 24 amino acids.

Human Umbilical Artery Vascular Endothelial Cell (HUAEC) Migration Tests

Human umbilical artery vascular endothelial cells (HUAECs) are inoculated into 4 $cm^2$ wells at high density (50,000 cells/well). When the monolayer is confluent, proliferation is stopped by incubation, overnight, in the presence of M199 (Life Sciences) containing 2% of FCS. A wound is then made in the monolayer using a foam scraper, making it possible to delimit a free surface of any cell. The monolayers are then washed 3 times with M199 in order to remove the non-adherent cells. A photograph is then taken in order to delimit the surface before any cell migration. The wells are then incubated in M199 and 2% of FCS alone or in the presence of 50 ng/ml of VEGF in the presence of variable concentrations of netrin 4 (NET-4) or netrin 1 (NET-1) or netrin G1 (NET-G1). After 24 hours, the wells are washed 3 times and stained with May-Grunwald-Giemsa and photographed and the cells counted in 8 fields per condition. The photographs taken before and after the experiment are then superimposed in order to allow counting of the cells having migrated. The results are expressed as the number of cells per field.

The results of these tests for netrin 4 are shown in FIG. 1.

According to FIG. 1, it is noted that the addition of NET-4 in the absence of VEGF has no effect on the basal migration of HUAEC cells. On the other hand, NET-4 inhibits the VEGF activity and 50% of the maximum effect is obtained with a concentration of 200 ng/ml of NET-4.

Smooth Muscle (VSM) Cell Migration Tests

Smooth muscle cells (VSM) are inoculated into 4 $cm^2$ wells at high density (50,000 cells/well). When the monolayer is confluent, proliferation is stopped by incubation, overnight, in the presence of M199 (Life Sciences) containing 2% of FCS. A wound is then made in the monolayer using a foam scraper, making it possible to delimit a free surface of any cell. The monolayers are then washed 3 times in DMEM in order to remove the non-adherent cells. A photograph is then taken in order to delimit the surface before any cell migration. The wells are then incubated in DMEM medium without FCS in the presence of variable concentrations of netrin 4 (NET-4) or netrin 1 (NET-1). After 24 hours the wells are washed 3 times and stained with May-Grunwald-Giemsa and photographed. The photographs taken before and after the experiment are then superimposed in order to allow counting of the cells having migrated.

The results of these tests are shown in FIG. 2.

According to FIG. 2, it is noted that netrin 1 and netrin 4 have a positive effect on VSM migration. In fact, netrin 1 and netrin 4 stimulate the migration of the smooth muscle cells and 50% of the maximum effect is obtained with a concentration of 20 ng/ml of NET-4.

Human Umbilical Artery Vascular Endothelial Cell (HUAEC) Proliferation Tests 96-well culture plates were seeded with 2,000 HUAEC cells per well in EBM with 10% of FCS added. The cells were stimulated or not stimulated with 2 ng/ml of $VEGF_{165}$ and different concentrations of netrin 1 or netrin 4. 5 mg/ml of anti-neogenin antibodies were added to certain wells. After 5 days, the wells were gently rinsed with DMEM and the cells were fixed in 1% of glutaldehyde for 20 minutes at ambient temperature. The fixed cells were quantified by incorporation of crystal violet (Kueng et al., 1989): the cells were incubated in 0.1% of crystal violet (Sigma) for 20 minutes at ambient temperature, the non-incorporated stain was eliminated by completely washing the wells with large quantities of water and the incorporated crystallized violet stain was then solubilized by 100 µl of 10% of acetic acid per well. The optical density readings were carried out at 595 nm. Similar results were obtained in three separate experiments (see FIG. 1). The values indicated are average optical densities of 6 wells ±SD.

The netrin 1 or netrin 4 proteins used alone have no significant effect on the basal proliferation (due to the serum alone). On the other hand, as indicated in FIG. 3, the netrin 4 protein inhibits the proliferation induced by the VEGF in a dose-dependent manner. 50% of the maximum effect is obtained with a concentration of 200 ng/ml. The addition of anti-neogenin antibodies completely reverses the inhibitory activity of the proliferation induced by netrin 1 or netrin 4.

Smooth Muscle (VSM) Cell Proliferation Tests 96-well culture plates were seeded with 2,000 VSM cells per well in DMEM medium with 10% of FCS added. After 6 hours the cells are transferred to DMEM medium containing 2% FCS then stimulated or not stimulated with different concentrations of netrin 1, netrin G1 or netrin 4. After 5 days, the wells were rinsed with DMEM and the cells were fixed in 1% of glutaldehyde, stained with crystal violet and solubilized by acetic acid. The optical density readings were carried out at 595 nm. Similar results were obtained in three separate experiments. The values indicated are average optical densities of 6 wells ±SD.

FIG. 4 shows that the proteins, netrin G1 and netrin 4 used alone have a significant effect on proliferation in a dose-dependent manner. 50% of the maximum effect is obtained with a concentration of 20 ng/ml. On the other hand netrin 1 has a non-significant effect on proliferation.

96-well culture plates were seeded with 2,000 VSM cells per well in DMEM medium with 10% of FCS added. After 6 hours the cells are transferred to DMEM medium containing 2% FCS then stimulated or not stimulated with different concentrations of netrin 1, netrin G1 or netrin 4. 5 pg/ml of anti-neogenin antibodies were added to certain wells. After 5 days, the wells were gently rinsed with DMEM and the cells were fixed in 1% of glutaldehyde for 20 minutes at ambient temperature. The fixed cells were quantified by incorporation of crystal violet (Kueng et al., 1989): the cells were incubated in 0.1% of crystal violet (Sigma) for 20 minutes at ambient temperature, the non-incorporated stain was eliminated by completely washing the wells with large quantities of water and the incorporated crystallized violet stain was then solubilized by 100 µl of 10% of acetic acid per well. The optical density readings were carried out at 595 nm. Similar results were obtained in three separate experiments (see FIG. 4). The values indicated are average optical densities of 6 wells ±SD.

FIG. 5 shows that the addition of anti-neogenin antibodies does not reverse the activity stimulating the proliferation induced by netrin 4.

Cell Adhesion Tests 96-well ELISA plates (Nunc) were covered with $VEGF_{165}$ protein according to the protocol described in the article by Hutchings et al. (2003), diluted in 0.05 M carbonate buffer at pH 9.6, overnight at 4° C. The non-specific binding sites were blocked for 1 hour at 37° C. with 5 mg/ml of BSA (bovine serum albumin) in carbonate buffer and washed twice with DMEM before the experiments. The cells were trypsinized, washed and resuspended in 5 ml of DMEM with 10% of FCS in a non-treated plastic tube and incubated for 1 hour at 37° C. with 10% of $CO_2$. The cells were then concentrated by centrifugation and resuspended in a DMEM+0.2% BSA mixture without serum and the cell suspension was treated for 20 minutes (37° C., 10% $CO_2$) with the netrin 4 protein used in order to modulate the adhesion. 40,000 cells per well were distributed into the wells in a volume of 100 µl of DMEM+ 0.2% of BSA. The cells were left to adhere at 37° C. under 10% $CO_2$ for the desired time. The wells were gently washed three times with DMEM in order to remove the non-adherent cells and the adherent cells were fixed with 1% of glutaraldehyde for 20 minutes at ambient temperature. The fixed cells were quantified by incorporation of crystal violet (Kueng et al., 1989): the cells were incubated with 0.1% of crystallized violet (Sigma) diluted in 0.2 M of borate buffer at pH 9.5 for 20 minutes at ambient temperature, the non-incorporated stain was eliminated by completely washing the wells with large quantities of water and the incorporated crystal violet stain was then solubilized by 100 µl of 10% of acetic acid per well.

Apoptosis Test 50,000 HUAEC cells are deposited in culture wells previously gelatinized in EBM medium containing 10% of FCS and 2 ng/ml of VEGF. 2 days later the cells are incubated overnight in EBM medium containing 2% of FCS and 200 ng/ml of netrin 4 in the presence or absence of FGF2 or VEGF. The cells are rinsed 24 hours later and incubated with propidium iodide, fixed and examined with a fluorescence microscope. The cells having fragmented nuclei are counted under fluorescence and the total cells are counted under direct lighting. The operation is carried out in at least 8 fields representing a minimum of 300 cells. The percentage of cells having a fragmented nucleus is then calculated.

Netrin 4 used alone has no significant effect on apoptosis. On the other hand, the netrin 4 protein completely inhibits the anti-apoptotic effect of VEGF or FGF-2 (see FIG. 6).

Production of Anti-Idiotypic Antibodies

In a first phase a neutralizing antibody of netrin 1, 3, G1 or 4 or of one of its abovementioned fragments (SEQ ID NO: 2 to 352) is prepared by injecting an animal, in particular a mouse, with said netrin or said fragment mixed with Freund's complete adjuvant (1 volume per volume of netrin or netrin fragment). A quantity of netrin or netrin fragment comprised between 10 and 500 µg/kg of body weight is chosen in order to immunize the animal. The same operation is carried out at intervals of 15 and 30 days, except that the complete adjuvant is replaced with incomplete adjuvant. On day 40 bloodletting is carried out, the serum is separated and the immunoglobulins are purified by any usual fractionation method, in particular precipitation with ammonium sulphate, protein A or G affinity chromatography. The neutralizing activity of the immunoglobulins is measured by any test described (for example, in the case of netrin 4 or one of its fragments, binding of labelled netrin 4 to the extracellular domain of any one of its receptors, proliferation, migration, cell adhesion). Thus, a batch of immunoglobulins is described as neutralizing when it has the ability to inhibit the interaction of netrin 1, 3, 4 or G1 with either the extracellular domain of dcc, neogenin, UNC5H1, UNC5H2, UNC5H3 or UNC5H4.

In a second phase, anti-idiotypic antibodies of netrin 1, 3, G1 or 4, or of one of their fragments are prepared by injecting mice by sub-cutaneous route with 1-100 µg of the preparation of the immunoglobulins neutralizing the activity of said netrin or of said fragment previously described in combination with 100 µl of adjuvant, in particular Freund's complete adjuvant (Sigma). The injection is repeated 15, 30 and 45 days later. Fifty-five days after the first injection, mice are injected with 10 µg of the same antibody by intraperitoneal route. Fifty-eight days after the first injection, the mice are sacrificed and their spleens are removed and dilacerated in ISCOVE medium in order to release the splenocytes. The splenocytes are fused with mouse myeloma cells, in particular AG8X 63 cells (Kearney et al., 1979), and incubated at a rate of 100,000 cells/well. The fusion is carried out by the addition of 20 times 50 µl of polyethylene glycol (PEG) at 30 second intervals. Four ml of ISCOVE medium preheated to 37° C. are then added dropwise to the cell suspension, then after a period of incubation of 4 minutes at 37° C., 4 ml are added. The suspension is centrifuged then the cell pellet is taken up in 100 ml of ISCOVE medium complemented with 20% of foetal calf serum and HAT 1× (50×: Hypoxanthine 5 mM, Aminopterine 20 µM and Thymidine 0.8 mM) and distributed at a rate of 100 µl per well on the macrophages. After 5 days, 100 µl of HAT medium are added, and between 8 and 14 days the conditioned medium of each hybridoma is sampled in order to measure by ELISA the antibodies directed against the antibodies having served as immunogenic agent, i.e. the anti-netrin 1, 3, G1 or 4 antibodies. The activity of the anti-idiotypic antibodies is then measured by an ELISA test:

The Fab fragments of the anti-netrin 1, 3, G1 or 4 immunoglobulins, prepared by any conventional technique, in particular papain digestion, are immobilized on microtitration plates (0.1-20 mg/ml in 50 mM carbonate buffer, pH 9.6). After saturation of the non-specific sites by a solution of serum albumin diluted to 5 mg/ml in the same buffer, the supernatants of hybridoma cultures are added diluted half-and-half in PBS buffer (buffer phosphate solution) containing 0.05% of Tween 20. After rinsing, the anti-idiotypic antibodies are developed by the addition of an appropriate concentration of mouse anti-Fc antibodies coupled with peroxidase. The quantity of fixed anti-idiotypic antibody is then measured by development of the peroxidase and is proportional to the intensity of the colorimetric reaction.

The hybridomas selected by their ability to secrete antibodies directed against anti-netrin 1, 3, G1 or 4 antibodies are then cloned, i.e. the cells are seeded under limited dilution conditions (5 cells/ml) under a volume of 0.1 ml per well. The medium is changed after 10 days. After 15 days, certain wells contain foci of cells which have multiplied from the cell seeded at the start, therefore all these cells are identical and have originated from the same clone. When the surface occupied by the cells represents at least half of the total surface of the wells, the medium is sampled and analyzed.

Then a second ELISA is implemented: goat immunoglobulins directed against the Fc domains of the human IgGs are incubated on microtitration plates (0.1-20 µg/ml in 50 mM carbonate buffer, pH 9.6). After saturation of the non-specific sites by a solution of serum albumin diluted to 5 mg/ml in the same buffer, the proteins containing the extracellular domains of the netrin receptors fused to a human IgG Fc sequence are immobilized on microtitration plates (incubation at a concentration comprised between 1 and 100 µg/ml). The supernatants of hybridoma cultures are added diluted half-and-half in PBS buffer containing 0.05% of Tween 20. After rinsing, the anti-idiotypic antibodies are shown by the addition of an appropriate concentration of mouse anti-Fc antibody coupled with peroxidase. The quantity of fixed anti-idiotypic antibody is then measured by development of the peroxidase and is proportional to the intensity of the colorimetric reaction.

Once the clones are identified, their monoclonal nature is affirmed by the standard operation which involves seeding a 96-well plate with cells originating from the same clone diluted under limit conditions as previously. The secreting clones must therefore all secrete an antibody of the same specificity in order for this antibody to be declared monoclonal. A third cloning is then carried out under exactly the same conditions in order to ensure that the clones are indeed monoclonal.

The monoclonal anti-idiotypic antibodies are screened by a battery of tests, in particular by an ELISA test on extracellular domains of the known receptors of netrins (dcc, neogenin, UNC5-A, UNC5-B, UNC5-C, UNC5-D), proliferation inhibition or HUAEC cell migration or tests measuring an anti-angiogenic activity in vivo.

The anti-idiotypic antibodies therefore mimic netrin domains. The aim is to produce an "internal image" of a netrin domain and therefore to be able to obtain an antibody binding 1 netrin receptor without binding all the receptors. Once the specificity is attested, the agonist function of this given antibody is determined by measuring its activity on cells, i.e. the HUAEC functions are inhibited without inhibiting or stimulating the functions of the netrins on the VSMs and/or on stimulating the VSMs without affecting the HUAECs.

The general benefit of these antibodies is their ability to mimic a function of the netrins on a target cell without affecting other targets. Thus, it would be beneficial to stimulate the functions of the pericytes without inducing the apoptosis of the endothelial cells or inhibiting their migration, their proliferation, their differentiation in certain pathologies:

age-related macular degeneration,
    diabetic retinopathies, at a early stage where the rarefaction of the pericytes precedes neovascularization,
    neovascular glaucoma (of the cornea, of the retina etc.),
    rheumatoid polyarthritis,
    psoriasis, in particular psoriatic polyarthritis,
    angiomas,
    atherosclerosis,
    obesity,
    cancer.

Conversely, it would be beneficial to inhibit the proliferation of the endothelial cells without affecting the pericytes for the above pathologies.

In Vitro Angiogenesis

Four rats' tails were skinned and dissected in order to recover the white bundles which are mostly constituted by type I collagen. The collagen is extracted from these fibres in 50 ml of cold 0.5 M acetic acid and stirred overnight. The liquid is then to centrifuged at 5000 g for 40 minutes and the supernatant is recovered. The extraction is repeated once with 20 ml of acetic acid, the supernatants are mixed and then dialyzed against 1 l of 0.2 M acetic acid. The collagen concentration is adjusted to 3 mg/ml by weight. The preparation of the gels for the in vitro angiogenesis is carried out on ice in order to preserve the collagen solution in liquid form. One ml of collagen (5 mg/ml) is mixed with 0.5 ml of DMEM 10× (containing a 10× concentration of antibiotics and glutamine), 0.9 ml of sterile $H_2O$ and 0.1 ml of 1M sodium bicarbonate. Once the pH has been adjusted to 7.4, an equal volume of matrigel (Becton Dickinson) is added. The gel is poured into culture wells (2 mm thick) and incubated at 37° C. in order to solidify. After 15 minutes the cells are added (100,000 cells/cm$^2$) to the surface of the gel. After 2 hours, the different soluble factors are added and the cells are observed and photographed after 24 hours.

Comparison of the Activity of NET-4 and NET-4m on VSM Proliferation (FIG. 7 A) and Migration (FIG. 7 B)

96-well culture plates were seeded with 2,000 VSM cells per well in DMEM medium with 10% of FCS added. After 6 hours the cells are transferred to DMEM medium containing 2% FCS then stimulated or not stimulated with different concentrations of netrin 4 (NET-4) or mutated netrin 4 (NET-4m). After 5 days, the wells were rinsed with DMEM and the cells were fixed in 1% of glutaldehyde, stained with crystal violet and solubilized by acetic acid. The optical density readings were carried out at 595 nm. Similar results were obtained in three separate experiments. The values indicated are average optical densities of 6 wells ±SD.

VSM Proliferation Test (FIG. 7 A)

Mutated netrin 4 was produced by transfection of CHO pgsA 745 cells by the vector containing the sequence of wild-type netrin 4 according to a protocol already described (Plouët, 1997). The protein was purified by heparin sepharose affinity chromatography and eluted by a discontinuous gradient of NaCl (0.3; 1.0 and 2.0 M NaCl). 4M NET is eluted by 2M NaCl, and has a degree of purity >90%.

The biological activity of NET 4 m was compared to that of wild-type NET 4 according to the smooth muscle cell proliferation test. FIG. 7 A shows that half of the maximum stimulation is obtained with a concentration of 120 ng/ml of non-mutated netrin 4 (NET-4) and 0.1 ng/ml of mutated netrin 4 (NET-4m). This means that the mitogenic activity of mutated netrin 4 is 1000 times greater than that of non-mutated netrin 4.

VSM Migration Test (FIG. 7 B)

The confluent VSM monolayer is incubated overnight in the presence of DMEM. A wound is then made in the monolayer using a foam scraper, then the wells are washed 3 times with DMEM then incubated in the presence of variable concentrations of netrin 4 (NET-4) or mutated netrin 4 (NET-4m). After 24 hours, the wells are washed 3 times and stained with May-Grunwald-Giemsa and photographed and the cells counted in 8 fields per condition. The results are expressed as the number of cells per field.

It appears that half of the maximum stimulation is obtained with a concentration of 12 ng/ml of non-mutated netrin 4 (NET-4) and 0.004 ng/ml of mutated netrin 4 (NET-4m). This means that the chemotactic activity of mutated netrin 4 is 3000 times greater than that of non-mutated netrin 4.

Transfection of PC3 Cancer Cells

Prostate cancer cells are cultured in DMEM medium with antibiotics and 10% of foetal calf serum added. The transfection protocol was established as follows:

D1: inoculation of cells at low density (10000 cells/cm$^2$) in a dish with a diameter of 10 cm D2: transfection by pcDNA3-NET4 or pcDNA-3-NET-4m
5 μg of plasmid are mixed with 5 μl of lipofectin and 100 μl of DMEM (without antibiotics) for 30 minutes at ambient temperature and stirred gently. The mixture is then diluted to 5 ml in DMEM and deposited dropwise in the dish containing PC3 cells. After incubation for 6 hours in an oven at 37° C., the medium is aspirated and replaced by 10 ml of fresh medium.

D3: rinsing of the dish and incubation for 24 hours with DMEM medium containing 10% of foetal calf serum and antibiotics D4: trypsinization of the cells, incubation in 4 dishes with a diameter of 10 cm in complete DMEM medium with 500 μg/ml of geneticin added (Sigma)

D17: sampling of clones of cells (100-400 cells/clone) using a micropipette and transfer to 2 cm$^2$ wells D24: trypsinization and incubation of the cell clones in 12-well dishes (120,000 cells/well)

D27: rinsing of the wells and inoculation in DMEM medium without serum

D30: collection of the conditioned media and analysis of the quantification of netrin 4 in each medium After having verified that the clones transfected by netrin 4 (NET-4) or mutated netrin 4 (NET-4m) have an equivalent duplication time (26-30 hours), the netrin 4 content of each medium was measured as described previously in the paragraph concerning the proliferation test. 4 μl of conditioned medium were added to 100 μl of culture medium. The results are expressed as a percentage of proliferation relative to the control (wells containing 4 μl of DMEM medium).

It appears from FIG. 8 that the medium of non-transfected cells as well as clones 10 and 15 of NET 4 induce an equivalent proliferation of the HUAEC cells, of the order of 300% relative to the control.

On the other hand the conditioned medium of clones 1, 5 of NET-4 m as well as clone 8 of NET-4 stimulate the proliferation of the HUAEC cells by only 200%, which corresponds to approximately 50% of the proliferation of PC3 cells induced by the conditioned medium.

Therefore netrin 4 (NET-4) or mutated netrin 4 (NET-4 m) inhibits HUAEC proliferation without modifying the proliferation of PC3 cancer cells.

Analysis of the Tumorigenicity of the Transfected PC3 Clones

Non-transfected PC3 cells and PC3 cells transfected by NET-4 m (clones 1 and 5) were injected into the flanks of nude mice (1 million cells per injection).

The length (L) and the width (w) of each tumor was measured with callipers and the volume expressed by the formula 0.52×L×w$^2$.

It appears from FIG. 9 that clones 1 and 5 produce much smaller tumors than the tumors obtained with PC3 cells. The reduction is greater than 80%.

Therefore mutated netrin 4 (NET-4 m) exhibits an antitumor activity by virtue of its anti-angiogenic activity.

Synergistic Effect of NET 4 on VEGF Inhibition.

It is now accepted that VEGF is a major factor in pathological angiogenesis and that its inhibition is a major therapeutic route. An anti-VEGF antibody is marketed under the name of AVASTIN. Knowing that netrin 4 (NET-4) acts by an action mechanism different from VEGF, we measured the synergistic effect of netrin 4 (NET 4) with an anti-VEGF antibody marketed under the name of AVASTIN.

Mice received a graft of non-transfected PC3 or of PC3 transfected by NET-4 clone 8 exhibiting a marginal reduction in the tumor volume or clone 10 or 15 which produce tumors with a volume equivalent to that of the non-transfected PC3 cells (not shown). Once the tumors exhibited a volume greater than 600 mm$^3$, the mice received a peritoneal injection of AVASTIN (50 µg every 3 days), a dose corresponding to the therapeutic recommendations in human pathology (5 mg/kg/week) and the tumor volume was measured as described previously.

It appears from FIG. 10 that the AVASTIN has no effect on the non-transfected PC3 tumors or PC3 clone 10 or 15 tumors which do not secrete sufficient NET-4 activity to inhibit tumor progression. After 4 days the increase in the tumor volume relative to the volume at the start of the treatment is 200, 150 and 200% respectively. On the other hand the volume of the clone 8 tumors, which secrete a significant NET-4 activity, remains stable: therefore netrin 4 makes it possible to restore sensitivity to the anti-VEGF treatments in tumors of significant size.

Choroidal Angiogenesis in Mice

Twelve 9-week-old C57BL/6J mice received a laser photocoagulation of the retina according to the following protocol.

The mice are anaesthetized by means of an intraperitoneal injection of sodium pentobarbital (Centravet) (200 µl per mouse of a solution diluted to 0.6 mg/100 µl). Once unconscious, the mice undergo pupil dilation with 1% tropicamide. A round glass disc 1 mm in diameter serves as a contact lens to magnify the fondus oculi. Then a laser impact (50 µm, 400 mW, 0.05 s) is carried out on each retina approximately 2 papillary diameters from the optic nerve on the nasal side.

After 7 days, the mice undergo local anaesthesia by ocular instillation of tetracaine and antisepsis by instillation of 5% betadine. Using a microcapillary microinjector, intravitreal injections of 1 µl of solution of PBS or netrin 4 at different concentrations are carried out. 3 mice are injected with PBS, 3 mice are injected with netrin 4 (0.1 mg/ml), 2 mice are injected with netrin 4 (0.3 mg/ml), 2 mice are injected with netrin 4 (1 mg/ml), 2 control mice undergo no injection.

After 10 days, the mice are sacrificed, enucleated by mounting both eyes in OCT then the retinas are cut with a microtome and developed by the anti-CD3 antibodies labelling the endothelial cells which appear in white.

Figure 11A:
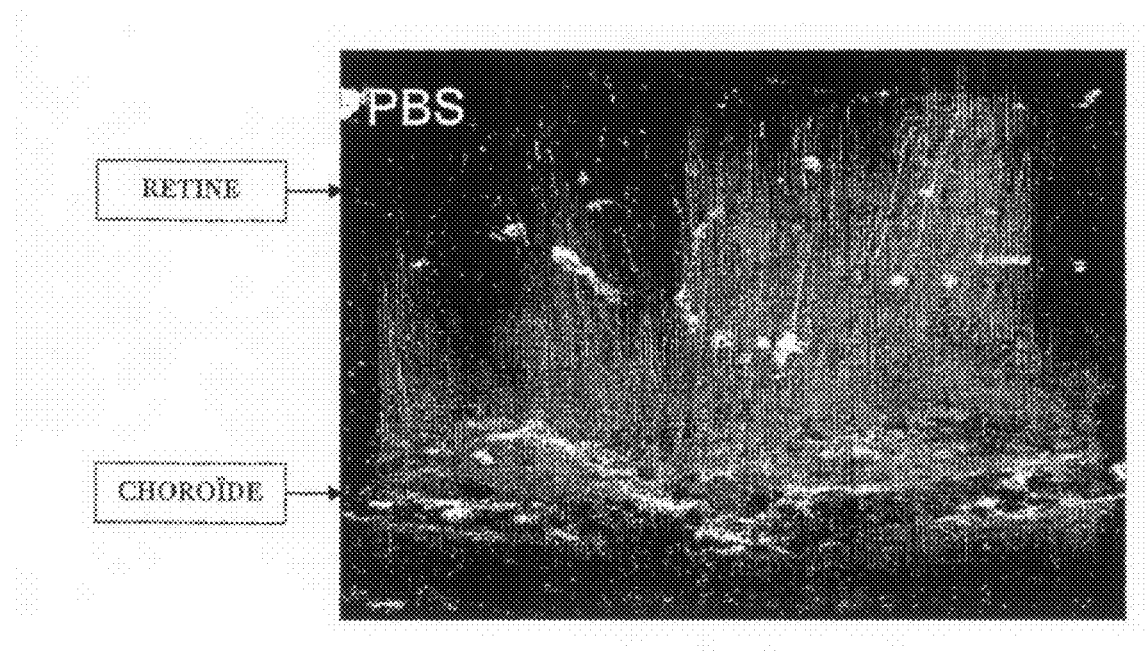
Figure 11B:
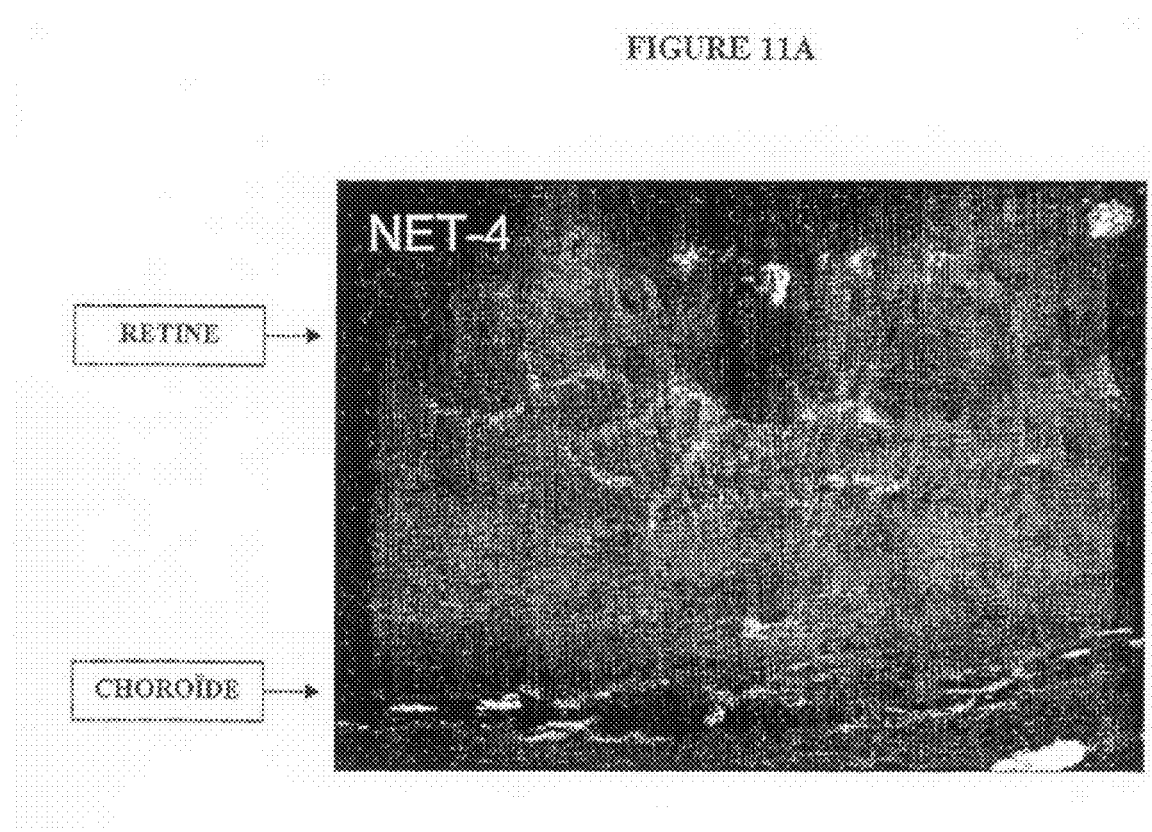
Figure 12A:
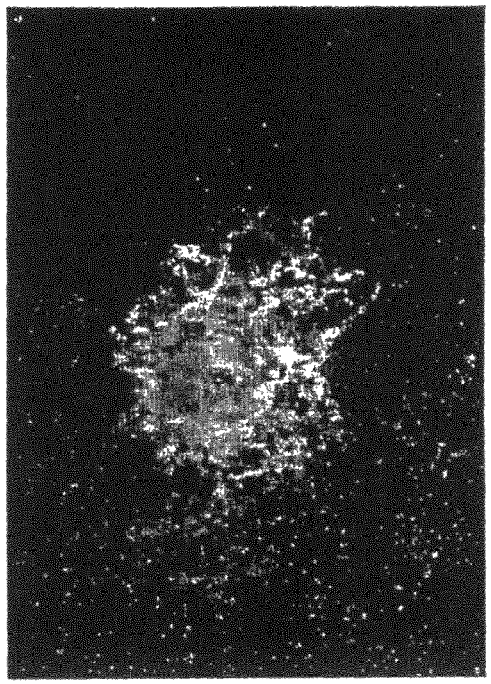
Figure 12B:
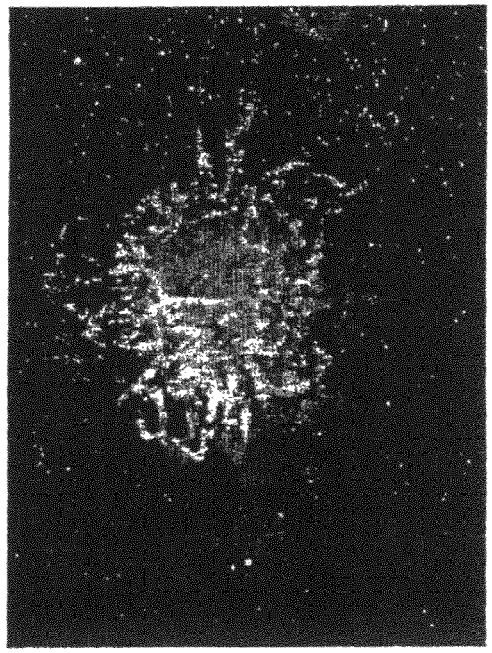
Figure 12C:
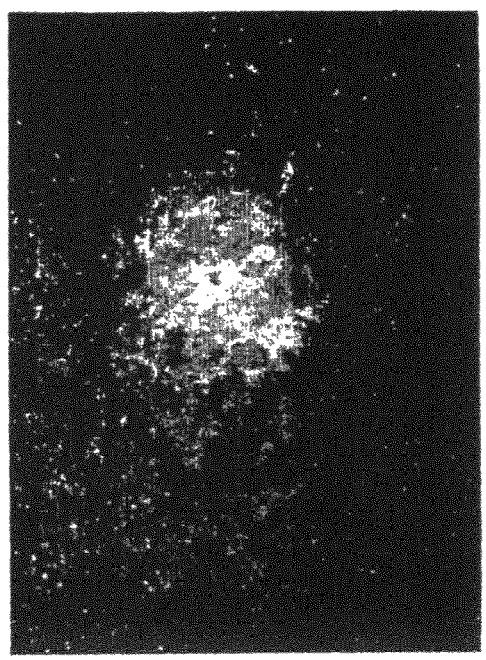
Figure 12D:
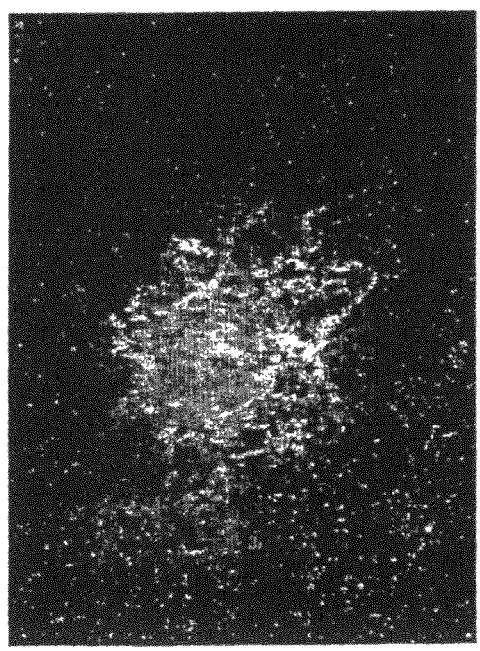

In FIGS. 11A and 11B, it appears that the injection of 0.1 and 0.3 µg of netrin 4 has no effect. On the other hand at a dose of 1 µg/eye there is a clear reduction in choroidal vascularization and glial inflammatory reaction.

In particular in FIG. 11A, there appears inside the retina a punctiform increase in vascularization and an efflorescence of all the choroidal vascularization in white.

FIG. 11B shows a reduction in retinal neovascularization but especially a reduction in the thickness of the neovascularized zone and in the number of vessels.

Choroidal Angiogenesis in Rats

Rats are anaesthetized by means of an intraperitoneal injection of sodium pentobarbital (Centravet) (200 µl per rat of a solution diluted to 0.6 mg/100 µl). Once unconscious, the rats undergo pupil dilation with 1% tropicamide. A round glass disc 12 mm in diameter serves as a contact lens to magnify the fondus oculi. Then three laser impacts (50 µm, 400 mW, 0.05 s) are carried out on each retina approximately 2 papillary diameters from the optic nerve on the nasal side.

After 7 and 10 days the rats received (4 per group, or 6-8 eyes analyzed per condition, therefore 12-18 impacts per condition) a sub-retinal injection (under a volume of 5 µl) containing:

PBS
NET-4 (2 µg)
NET-1 (2 µg)
NET-4 m and purified (100 pg)

After 14 days the rats were anaesthetized, perfused by a solution of fluorescent dextran (in white) which makes it possible to visualize the perfusion of the vessels. The retinas were then mounted flat and photographed.

In the eyes treated with the vehicle alone a central zone marked in grey is seen at the level of the impact corresponding to an endothelial proliferation and a crown of vessels marked in white. These vessels being visualized by fluorescent dextran, it is possible to affirm that they are functional. It appears that the injections of NET-4 and NET-1 have a marginal effect at 2 µg/rat. On the other hand, the injection of 100 pg of NET-4 m almost totally inhibits perfusion and therefore choroidal neovascularization.

The quantification was carried out by measuring the pixels per µ$^2$ and reduces perfusion by 50%.

The results in FIGS. 12A to 12D show that netrin 1 and netrin 4 produce a marginal reduction in neovascularization relative to the control whereas a 2000 times lower dose of mutated netrin 4 produces significantly large reduction: p less than 0.02.

Effect of NET-4 m (MC4) and the Fragment of Sequence SEQ ID NO: 528 on VSM Migration (MC5).

CHO pgsA-745 cells were transfected with the PCDNA-3 expression vectors containing the complete sequence of mutated netrin 4 (MC4) or sequence SEQ ID NO: 528 (MC5). After 16 hours the cells are incubated with DMEM medium and the conditioned media collected after 48 hours. The migration activity on the VSM cells is measured as described previously (see FIG. 13).

In FIG. 13, it appears that MC4 and MC5 have the same specific activity (equivalent to 2 µg/ml of reference netrin 4). Therefore the deletion of 340 amino acids situated at C-terminal position does not affect the function of mutated netrin 4.

REFERENCES

Celerier J, Cruz A, Lamande N, Gasc J M, Corvol P (2002) Angiotensinogen and its cleaved derivatives inhibit angiogenesis. *Hypertension.* 39(2):224-8, Cooper H M, Gad J M, Keeling S L (1999) The Deleted in Colorectal Cancer netrin guidance system: a molecular strategy for neuronal navigation. *Clin Exp Pharmacol Physiol.* 26(9): 749-51;

Corset V, Nguyen-Ba-Charvet K T, Forcet C, Moyse E, Chedotal A, Mehlen P (2000) Netrin-1-mediated axon outgrowth and cAMP production requires interaction with adenosine A2b receptor. *Nature.* 407: 747-50;

Hutchings H, Ortéga N, Plouët J (2003) Extracellular matrix bound vascular endothelial growth factor promotes endothelial cell adhesion, migration and survival through integrin ligation. *FASEB J.* 17: 1520-1522;

Inoki I, Shiomi T, Hashimoto G, Enomoto H, Nakamura H, Makino K, Ikeda E, Takata S, Kobayashi K, Okada Y (2002) Connective tissue growth factor binds vascular endothelial growth factor (VEGF) and inhibits VEGF-induced angiogenesis. *FASEB J.* 16(2):219-21, Jain R K, Schlenger K, Hockel M, Yuan F (1997) Quantitative angiogenesis assays: progress and problems. Nat. Med. 3(11):1203-8, Kearney J F, Radbruch A, Liesegang B, Rajewsky K (1979) A new mouse myeloma cell line that has lost immunoglobulin expression but permits the construction of antibody-secreting hybrid cell lines. *J. Immunol.* 123, 1548-50;

Kueng W, Silber E, Eppenberger U (1989) Quantification of cell cultures on 96-well plates. *Anal. Biochem,* 182(1): 16-9;

Livesey F J (1999) Netrins and netrin receptors. *Cell Mol Life Sci,* 56(1-2): 62-8;

Lu X, le Noble F, Yuan L, Jiang Q, de Lafarge B, Sugiyama D, Breant C, Claes F, De Smet F, Thomas J L, Autiero M, Carmeliet P, Tessier-Lavigne M, Eichmann A (2004) The netrin receptor UNC5B mediates guidance events controlling morphogenesis of the vascular system. *Nature.* 432: 179-186;

Matsunaga E, Tauszig-Delamasure S, Monnier P P, Mueller B K, Strittmatter S M, Mehlen P, Chedotal A (2004) RGM and its receptor neogenin regulate neuronal survival. *Nat Cell Biol.* 8, 749-755;

Mehlen P, Mazelin L (2003) The dependence receptors DCC and UNC5H as a link between neuronal guidance and survival. *Biol Cell.* 95(7): 425-36;

Nakashiba T, Ikeda T, Nishimura S, Tashiro K, Honjo T, Culotti J G, Itohara S (2000) Netrin-G1: a novel glycosyl phosphatidylinositol-linked mammalian netrin that is functionally divergent from classical netrins. *J Neurosci.* 20(17): 6540-50;

Papanikolaou, G, Ludwig, E H, MacDonald, M L, Franchini, P L, Dube, M-P, Andres, L, MacFarlane, J, Sakellaropoulos, N, Politou, M, Nemeth, E, Thompson, J, Risler, J, Zaborowska, C, Babakaiff, R, Radomski, C C, Christakis, J L, Brissot, P, Lockitch, G, Ganz, T, Hayden, M R, Samuels, M E et Goldberg, P (2004) Mutations in HFE2 cause iron overload in chromosome 1q linked juvenile hemochromatosis. *Nat. Genet.* 77-82 36, 77-82;

Plouët J, Moro F, Coldeboeuf N, Bertagnolli S, Clamens S, Bayard F (1997) Extracellular cleavage of the vascular endothelial growth factor 189 aa form by urokinae is required for its mitogenic activity. *J. Biol. Chem.,* 272, 13390-13396;

Yurchenco P D, Wadsworth W G (2004) Assembly and tissue functions of early embryonic laminins and netrins. *Curr Opin Cell Biol.* 16(5):572-9.

Arnal J F, Gourdy P, Garmy-Susini B, Delmas E, Bayard F (2003) Usefulness of experimental models to understand the vascular effects of estrogens. *Med Sci* (Paris). 19(12): 1226-32;

Brooks P C, Clark R A, Cheresh D A (1994) Requirement of vascular integrin alpha v beta 3 for angiogenesis. *Science,* 264, 569-71;

O'Reilly et al. (1997) *Cell* 88:277-285;

Ortéga N, Hutchings H, Plouët J (1999) Signal relays in the VEGF system. *Front. Biosc.,* 4, D141-D152;

SEQUENCE LISTING (532 sequences)

SEQ ID NO: 1 - DNA, 180 bp, Homo sapiens
  CDS (1)..(180)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 2 - protein, 60 aa, Homo sapiens
SCFCNGHADQCIPVHGFRPVKAPGTFHMVHGKCMCKHNTAGSHCQHCAPLYNDRPWEAAD

SEQ ID NO: 3 - DNA, 168 bp, Homo sapiens
  CDS (1)..(168)
tgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 4 - protein, 56 aa, Homo sapiens
CKCNGHADTCHFDVNVWEASGNRSGGVCDDCQHNTEGQYCQRCKPGFYRDLRRPFS

SEQ ID NO: 5 - DNA, 156 bp, Homo sapiens
  CDS (1)..(156)
ccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 6 - protein, 52 aa, Homo sapiens
PCSCHPVGSAVLPANSVTFCDPSNGDCPCKPGVAGRRCDRCMVGYWGFGDYG

SEQ ID NO: 7 - DNA, 687 bp, Homo sapiens
  CDS (1)..(687)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggc

SEQ ID NO: 8 - protein, 229 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKG

SEQ ID NO: 9 - DNA, 1119 bp, Homo sapiens
  CDS (1)..(1119)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 10 - protein, 373 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 11 - DNA, 1104 bp, Homo sapiens
  CDS (1)..(1104)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 12 - protein, 368 aa, Homo sapiens
SCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 13 - DNA, 960 bp, Homo sapiens
  CDS (1)..(960)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 14 - protein, 320 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 15 - DNA, 948 bp, Homo sapiens
  CDS (1)..(948)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 16 - protein, 316 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFS

SEQ ID NO: 17 - DNA, 936 bp, Homo sapiens
  CDS (1)..(936)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 18 - protein, 312 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYG

SEQ ID NO: 19 - DNA, 867 bp, Homo sapiens
  CDS (1)..(867)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 20 - protein, 289 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 21 - DNA, 855 bp, Homo sapiens
  CDS (1)..(855)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 22 - protein, 285 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFS

SEQ ID NO: 23 - DNA, 843 bp, Homo sapiens
  CDS (1)..(843)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 24 - protein, 281 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYG

SEQ ID NO: 25 - DNA, 348 bp, Homo sapiens
  CDS (1)..(348)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 26 - protein, 116 aa, Homo sapiens
SCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFS

SEQ ID NO: 27 - DNA, 324 bp, Homo sapiens
  CDS (1)..(324)
tgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 28 - protein, 108 aa, Homo sapiens
CKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 29 - DNA, 336 bp, Homo sapiens
  CDS (1)..(336)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 30 - protein, 112 aa, Homo sapiens
SCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 31 - DNA, 504 bp, Homo sapiens
  CDS (1)..(504)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 32 - protein, 168 aa, Homo sapiens
SCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 33 - DNA, 1128 bp, Homo sapiens
  CDS (1)..(1128)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 34 - protein, 376 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFS

SEQ ID NO: 35 - DNA, 1104 bp, Homo sapiens
  CDS (1)..(1104)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 36 - protein, 368 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 37 - DNA, 1116 bp, Homo sapiens
  CDS (1)..(1116)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 38 - protein, 372 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 39 - DNA, 1035 bp, Homo sapiens
  CDS (1)..(1035)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 40 - protein, 345 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFS

SEQ ID NO: 41 - DNA, 1011 bp, Homo sapiens
  CDS (1)..(1011)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 42 - protein, 337 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 43 - DNA, 1023 bp, Homo sapiens
  CDS (1)..(1023)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 44 - protein, 341 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 45 - DNA, 1284 bp, Homo sapiens
  CDS (1)..(1284)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 46 - protein, 428 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 47 - DNA, 1191 bp, Homo sapiens
  CDS (1)..(1191)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 48 - protein, 397 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 49 - DNA, 519 bp, Homo sapiens
  CDS (1)..(519)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 50 - protein, 173 aa, Homo sapiens
SCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 51 - DNA, 507 bp, Homo sapiens
  CDS (1)..(507)
tgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 52 - protein, 169 aa, Homo sapiens
CKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 53 - DNA, 495 bp, Homo sapiens
  CDS (1)..(495)
ccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 54 - protein, 165 aa, Homo sapiens
PCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55 - DNA, 1026 bp, Homo sapiens
  CDS (1)..(1026)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 56 - protein, 342 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 57 - DNA, 1206 bp, Homo sapiens
  CDS (1)..(1206)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 58 - protein, 402 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 59 - DNA, 1194 bp, Homo sapiens
  CDS (1)..(1194)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 60 - protein, 398 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 61 - DNA, 1182 bp, Homo sapiens
  CDS (1)..(1182)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 62 - protein, 394 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 63 - DNA, 1299 bp, Homo sapiens
  CDS (1)..(1299)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 64 - protein, 433 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 65 - DNA, 1287 bp, Homo sapiens
  CDS (1)..(1287)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 66 - protein, 429 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 67 - DNA, 1275 bp, Homo sapiens
  CDS (1)..(1275)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 68 - protein, 425 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 69 - DNA, 687 bp, Homo sapiens
  CDS (1)..(687)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 70 - protein, 229 aa, Homo sapiens
SCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 71 - DNA, 675 bp, Homo sapiens
  CDS (1)..(675)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 72 - protein, 225 aa, Homo sapiens
SCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 73 - DNA, 663 bp, Homo sapiens
  CDS (1)..(663)
tgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 74 - protein, 221 aa, Homo sapiens
CKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 75 - DNA, 843 bp, Homo sapiens
  CDS (1)..(843)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 76 - protein, 281 aa, Homo sapiens
SCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 77 - DNA, 1467 bp, Homo sapiens
  CDS (1)..(1467)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 78 - protein, 489 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 79 - DNA, 1443 bp, Homo sapiens
  CDS (1)..(1443)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 80 - protein, 481 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 81 - DNA, 1455 bp, Homo sapiens
  CDS (1)..(1455)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 82 - protein, 485 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 83 - DNA, 1374 bp, Homo sapiens
  CDS (1)..(1374)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 84 - protein, 458 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 85 - DNA, 1350 bp, Homo sapiens
  CDS (1)..(1350)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 86 - protein, 450 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 87 - DNA, 1362 bp, Homo sapiens
  CDS (1)..(1362)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 88 - protein, 454 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 89 - DNA, 1623 bp, Homo sapiens
  CDS (1)..(1623)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 90 - protein, 541 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 91 - DNA, 1530 bp, Homo sapiens
  CDS (1)..(1530)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 92 - protein, 510 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 93 - DNA, 723 bp, Homo sapiens
  CDS (1)..(723)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggc

SEQ ID NO: 94 - protein, 241 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKG

SEQ ID NO: 95 - DNA, 1488 bp, Homo sapiens
  CDS (1)..(1488)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaat

SEQ ID NO: 96 - protein, 496 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 97 - DNA, 1062 bp, Homo sapiens
  CDS (1)..(1062)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactagatattttaaaaagagagtgcaagattgtgaatatgaaaagctttgtccagcactggaaaccttctcttggaagaaaagtcatg

SEQ ID NO: 98 - protein, 354 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLDILKRECKIVNMKSFVQHWKPSLGRKVM

SEQ ID NO: 99 - DNA, 903 bp, Homo sapiens
  CDS (1)..(903)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 100 - protein, 301 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 101 - DNA, 891 bp, Homo sapiens
  CDS (1)..(891)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 102 - protein, 297 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFS

SEQ ID NO: 103 - DNA, 879 bp, Homo sapiens
  CDS (1)..(879)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 104 - protein, 293 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYG

SEQ ID NO: 105 - DNA, 1071 bp, Homo sapiens
  CDS (1)..(1071)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctca

SEQ ID NO: 106 - protein, 357 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFS

SEQ ID NO: 107 - DNA, 1047 bp, Homo sapiens
  CDS (1)..(1047)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 108 - protein, 349 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 109 - DNA, 1059 bp, Homo sapiens
  CDS (1)..(1059)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 110 - protein, 353 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 111 - DNA, 1227 bp, Homo sapiens
  CDS (1)..(1227)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 112 - protein, 409 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 113 - DNA, 1242 bp, Homo sapiens
  CDS (1)..(1242)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 114 - protein, 414 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 115 - DNA, 1230 bp, Homo sapiens
  CDS (1)..(1230)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 116 - protein, 410 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 117 - DNA, 1218 bp, Homo sapiens
  CDS (1)..(1218)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 118 - protein, 406 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 119 - DNA, 1410 bp, Homo sapiens
  CDS (1)..(1410)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 120 - protein, 470 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 121 - DNA, 1386 bp, Homo sapiens
  CDS (1)..(1386)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 122 - protein, 462 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 123 - DNA, 1398 bp, Homo sapiens
  CDS (1)..(1398)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 124 - protein, 466 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 125 - DNA, 1566 bp, Homo sapiens
  CDS (1)..(1566)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgattgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 126 - protein, 522 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADCKCNGHADTCHFDVNVWEASGNRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 127 - DNA, 849 bp, Homo sapiens
  CDS (1)..(849)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggc

SEQ ID NO: 128 - protein, 283 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGG

SEQ ID NO: 129 - DNA, 612 bp, Homo sapiens
  CDS (1)..(612)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatg

SEQ ID NO: 130 - protein, 204 aa, Homo sapiens
RCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINM

SEQ ID NO: 131 - DNA, 354 bp, Homo sapiens
  CDS (1)..(354)
aaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 132 - protein, 117 aa, Homo sapiens
KKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 133 - DNA, 144 bp, Homo sapiens
  CDS (1)..(144)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccaca

SEQ ID NO: 134 - protein, 48 aa, Homo sapiens
RCKCNGHAARCVRDRTDSLVCDCRHNTAGPECDRCKPFHYDRPWQRAT

SEQ ID NO: 135 - DNA, 168 bp, Homo sapiens
  CDS (1)..(168)
tgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 136 - protein, 56 aa, Homo sapiens
CNCNLHARRCRFNMELYKLSGRKSGGVCLNCRHNTAGRHCHYCKEGYYRDMGKPIT

SEQ ID NO: 137 - DNA, 144 bp, Homo sapiens
  CDS (1)..(144)
gcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 138 - protein, 48 aa, Homo sapiens
ACDCHPVGAAGKTCNQTTGQCPCKDGVTGITCNRCAKGYQQSRSPIAP

SEQ ID NO: 139 - DNA, 705 bp, Homo sapiens
  CDS (1)..(705)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggc

SEQ ID NO: 140 - protein, 235 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGG

SEQ ID NO: 141 - DNA, 1203 bp, Homo sapiens
  CDS (1)..(1203)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 142 - protein, 400 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 143 - DNA, 966 bp, Homo sapiens
  CDS (1)..(966)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 144 - protein, 321 aa, Homo sapiens
RCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 145 - DNA, 1317 bp, Homo sapiens
  CDS (1)..(1317)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatg

SEQ ID NO: 146 - protein, 439 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINM

SEQ ID NO: 147 - DNA, 1671 bp, Homo sapiens
  CDS (1)..(1671)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 148 - protein, 556 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 149 - DNA, 993 bp, Homo sapiens
  CDS (1)..(993)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccaca

SEQ ID NO: 150 - protein, 331 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRAT

SEQ ID NO: 151 - DNA, 1017 bp, Homo sapiens
  CDS (1)..(1017)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 152 - protein, 339 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPIT

SEQ ID NO: 153 - DNA, 993 bp, Homo sapiens
  CDS (1)..(993)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 154 - protein, 331 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAP

SEQ ID NO: 155 - DNA, 849 bp, Homo sapiens
  CDS (1)..(849)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccaca

SEQ ID NO: 156 - protein, 283 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRAT

SEQ ID NO: 157 - DNA, 873 bp, Homo sapiens
  CDS (1)..(873)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 158 - protein, 291 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPIT

SEQ ID NO: 159 - DNA, 849 bp, Homo sapiens
  CDS (1)..(849)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 160 - protein, 283 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAP

SEQ ID NO: 161 - DNA, 312 bp, Homo sapiens
  CDS (1)..(312)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 162 - protein, 104 aa, Homo sapiens
RCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPIT

SEQ ID NO: 163 - DNA, 312 bp, Homo sapiens
  CDS (1)..(312)
tgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 164 - protein, 104 aa, Homo sapiens
CNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 165 - DNA, 288 bp, Homo sapiens
  CDS (1)..(288)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 166 - protein, 96 aa, Homo sapiens
RCKCNGHAARCVRDRTDSLVCDCRHNTAGPECDRCKPFHYDRPWQRATACDCHPVGAAGKTCNQTTGQCPCKDGVTGITCNRCAKGYQQSRSPIAP

SEQ ID NO: 167 - DNA, 456 bp, Homo sapiens
  CDS (1)..(456)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 168 - protein, 152 aa, Homo sapiens
RCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 169 - DNA, 1161 bp, Homo sapiens
  CDS (1)..(1161)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 170 - protein, 387 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPIT

SEQ ID NO: 171 - DNA, 1161 bp, Homo sapiens
  CDS (1)..(1161)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 172 - protein, 387 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 173 - DNA, 1137 bp, Homo sapiens
  CDS (1)..(1137)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 174 - protein, 379 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAP

SEQ ID NO: 175 - DNA, 1017 bp, Homo sapiens
  CDS (1)..(1017)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 176 - protein, 339 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPIT

SEQ ID NO: 177 - DNA, 1017 bp, Homo sapiens
  CDS (1)..(1017)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 178 - protein, 339 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 179 - DNA, 993 bp, Homo sapiens
  CDS (1)..(993)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 180 - protein, 331 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAP

SEQ ID NO: 181 - DNA, 1305 bp, Homo sapiens
  CDS (1)..(1305)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 182 - protein, 435 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 183 - DNA, 1161 bp, Homo sapiens
  CDS (1)..(1161)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 184 - protein, 387 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 185 - DNA, 498 bp, Homo sapiens
  CDS (1)..(498)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacaaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 186 - protein, 165 aa, Homo sapiens
RCKCNGHAARCVRDRTDSLVCDCRHNTAGPECDRCKPFHYDRPWQRATKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 187 - DNA, 522 bp, Homo sapiens
  CDS (1)..(522)
tgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 188 - protein, 173 aa, Homo sapiens
CNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 189 - DNA, 498 bp, Homo sapiens
  CDS (1)..(498)
gcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 190 - protein, 165 aa, Homo sapiens
ACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 191 - DNA, 1059 bp, Homo sapiens
  CDS (1)..(1059)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 192 - protein, 352 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 193 - DNA, 1203 bp, Homo sapiens
  CDS (1)..(1203)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacaaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 194 - protein, 400 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 195 - DNA, 1227 bp, Homo sapiens
  CDS (1)..(1227)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 196 - protein, 408 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 197 - DNA, 1203 bp, Homo sapiens
  CDS (1)..(1203)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 198 - protein, 400 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 199 - DNA, 1347 bp, Homo sapiens
  CDS (1)..(1347)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacaaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 200 - protein, 448 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 201 - DNA, 1371 bp, Homo sapiens
  CDS (1)..(1371)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 202 - protein, 456 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 203 - DNA, 1347 bp, Homo sapiens
  CDS (1)..(1347)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 204 - protein, 448 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 205 - DNA, 666 bp, Homo sapiens
  CDS (1)..(666)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 206 - protein, 221 aa, Homo sapiens
RCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 207 - DNA, 642 bp, Homo sapiens
  CDS (1)..(642)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 208 - protein, 213 aa, Homo sapiens
RCKCNGHAARCVRDRTDSLVCDCRHNTAGPECDRCKPFHYDRPWQRATACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 209 - DNA, 666 bp, Homo sapiens
  CDS (1)..(666)
tgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 210 - protein, 221 aa, Homo sapiens
CNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 211 - DNA, 810 bp, Homo sapiens
  CDS (1)..(810)
cggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 212 - protein, 269 aa, Homo sapiens
RCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 213 - DNA, 1515 bp, Homo sapiens
  CDS (1)..(1515)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 214 - protein, 504 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 215 - DNA, 1515 bp, Homo sapiens
  CDS (1)..(1515)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 216 - protein, 504 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 217 - DNA, 1491 bp, Homo sapiens
  CDS (1)..(1491)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 218 - protein, 496 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 219 - DNA, 1371 bp, Homo sapiens
  CDS (1)..(1371)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 220 - protein, 456 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 221 - DNA, 1371 bp, Homo sapiens
  CDS (1)..(1371)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 222 - protein, 456 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 223 - DNA, 1347 bp, Homo sapiens
  CDS (1)..(1347)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 224 - protein, 448 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 225 - DNA, 1659 bp, Homo sapiens
  CDS (1)..(1659)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 226 - protein, 552 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 227 - DNA, 1515 bp, Homo sapiens
  CDS (1)..(1515)
cgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 228 - protein, 504 aa, Homo sapiens
RRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 229 - DNA, 777 bp, Homo sapiens
  CDS (1)..(777)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggc

SEQ ID NO: 230 - protein, 259 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGG

SEQ ID NO: 231 - DNA, 1389 bp, Homo sapiens
  CDS (1)..(1389)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatg

SEQ ID NO: 232 - protein, 463 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINM

SEQ ID NO: 233 - DNA, 1131 bp, Homo sapiens
  CDS (1)..(1131)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 234 - protein, 376 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 235 - DNA, 921 bp, Homo sapiens
  CDS (1)..(921)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccaca

SEQ ID NO: 236 - protein, 307 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRAT

SEQ ID NO: 237 - DNA, 945 bp, Homo sapiens
  CDS (1)..(945)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 238 - protein, 315 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPIT

SEQ ID NO: 239 - DNA, 921 bp, Homo sapiens
  CDS (1)..(921)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 240 - protein, 307 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAP

SEQ ID NO: 241 - DNA, 1089 bp, Homo sapiens
  CDS (1)..(1089)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacc

SEQ ID NO: 242 - protein, 363 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPIT

SEQ ID NO: 243 - DNA, 1089 bp, Homo sapiens
  CDS (1)..(1089)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 244 - protein, 363 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 245 - DNA, 1065 bp, Homo sapiens
  CDS (1)..(1065)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 246 - protein, 355 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAP

SEQ ID NO: 247 - DNA, 1233 bp, Homo sapiens
  CDS (1)..(1233)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccc

SEQ ID NO: 248 - protein, 411 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAP

SEQ ID NO: 249 - DNA, 1275 bp, Homo sapiens
  CDS (1)..(1275)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacaaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 250 - protein, 424 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 251 - DNA, 1299 bp, Homo sapiens
  CDS (1)..(1299)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 252 - protein, 432 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 253 - DNA, 1275 bp, Homo sapiens
  CDS (1)..(1275)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggcgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 254 - protein, 424 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 255 - DNA, 1443 bp, Homo sapiens
  CDS (1)..(1443)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 256 - protein, 480 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 257 - DNA, 1443 bp, Homo sapiens
  CDS (1)..(1443)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 258 - protein, 480 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 259 - DNA, 1419 bp, Homo sapiens
  CDS (1)..(1419)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 260 - protein, 472 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 261 - DNA, 1587 bp, Homo sapiens
  CDS (1)..(1587)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacatgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcaccgcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgcccccaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 262 - protein, 528 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATCNCNLHARRCRFNMELYKLSGRKSGGVCLNCRHNTAGRHCHYCKEGYYRDMGKPITACDCHPVGAAGKTCNQTTGQCPCKDGVTGITCNRCAKGYQQSRSPIAPKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 263 - DNA, 885 bp, Homo sapiens
  CDS (1)..(885)
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgagga

SEQ ID NO: 264 - protein, 295 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRG

SEQ ID NO: 265 - DNA, 432 bp, Homo sapiens
  CDS (1)..(432)
aggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 266 - protein, 143 aa, Homo sapiens
RCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 267 - DNA, 675 bp, Homo sapiens
  CDS (1)..(675)
acctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgagga

SEQ ID NO: 268 - protein, 225 aa, Homo sapiens
TCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRG

SEQ ID NO: 269 - DNA, 141 bp, Homo sapiens
  CDS (1)..(141)
aggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcc

SEQ ID NO: 270 - protein, 47 aa, Homo sapiens
RCKCNLHATVCVYDNSKLTCECEHNTTGPDCGKCKKNYQGRPWSPGS

SEQ ID NO: 271 - DNA, 111 bp, Homo sapiens
  CDS (1)..(111)
tgccagaacggagggacgtgccacaacaacgtgcgctgcctgtgcccggccgcatacacgggcatcctctgcgagaagctgcggtgcgaggaggctggcagctgcggctcc

SEQ ID NO: 272 - protein, 37 aa, Homo sapiens
CQNGGTCHNNVRCLCPAAYTGILCEKLRCEEAGSCGS

SEQ ID NO: 273 - DNA, 1026 bp, Homo sapiens
  CDS (1)..(1026)
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcc

SEQ ID NO: 274 - protein, 342 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGS

SEQ ID NO: 275 - DNA, 996 bp, Homo sapiens
  CDS (1)..(996)
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggatgccagaacggagggacgtgccacaacaacgtgcgctgcctgtgcccggccgcatacacgggcatcctctgcgagaagctgcggtgcgaggaggctggcagctgcggctcc

SEQ ID NO: 276 - protein, 332 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGCQNGGTCHNNVRCLCPAAYTGILCEKLRCEEAGSCGS

SEQ ID NO: 277 - DNA, 1137 bp, Homo sapiens
  CDS (1)..(1137)
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctgccagaacggagggacgtgccacaacaacgtgcgctgcctgtgcccggccgcatacacgggcatcctctgcgagaagctgcggtgcgaggaggctggcagctgcggctcc

SEQ ID NO: 278 - protein, 379 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSCQNGGTCHNNVRCLCPAAYTGILCEKLRCEEAGSCGS

SEQ ID NO: 279 - DNA, 1107 bp, Homo sapiens
  CDS (1)..(1107)
acctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 280 - protein, 368 aa, Homo sapiens
TCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 281 - DNA, 816 bp, Homo sapiens
  CDS (1)..(816)
acctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcc

SEQ ID NO: 282 - protein, 272 aa, Homo sapiens
TCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGS

SEQ ID NO: 283 - DNA, 786 bp, Homo sapiens
  CDS (1)..(786)
acctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggatgccagaacggagggacgtgccacaacaacgtgcgctgcctgtgcccggccgcatacacgggcatcctctgcgagaagctgcggtgcgaggaggctggcagctgcggctcc

SEQ ID NO: 284 - protein, 262 aa, Homo sapiens
TCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGCQNGGTCHNNVRCLCPAAYTGILCEKLRCEEAGSCGS

SEQ ID NO: 285 - DNA, 252 bp, Homo sapiens
  CDS (1)..(252)
aggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctgccagaacggagggacgtgccacaacaacgtgcgctgcctgtgcccggccgcatacacgggcatcctctgcgagaagctgcggtgcgaggaggctggcagctgcggctcc

SEQ ID NO: 286 - protein, 84 aa, Homo sapiens
RCKCNLHATVCVYDNSKLTCECEHNTTGPDCGKCKKNYQGRPWSPGSCQNGGTCHNNVRCLCPAAYTGILCEKLRCEEAGSCGS

SEQ ID NO: 287 - DNA, 927 bp, Homo sapiens
  CDS (1)..(927)
acctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctgccagaacggagggacgtgccacaacaacgtgcgctgcctgtgcccggccgcatacacgggcatcctctgcgagaagctgcggtgcgaggaggctggcagctgcggctcc

SEQ ID NO: 288 - protein, 309 aa, Homo sapiens
TCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSCQNGGTCHNNVRCLCPAAYTGILCEKLRCEEAGSCGS

SEQ ID NO: 289 - DNA, 801 bp, Homo sapiens
  CDS (1)..(801)
cattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgagga

SEQ ID NO: 290 - protein, 267 aa, Homo sapiens
HYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRG

SEQ ID NO: 291 - DNA, 942 bp, Homo sapiens
  CDS (1)..(942)
cattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcc

SEQ ID NO: 292 - protein, 314 aa, Homo sapiens
HYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGS

SEQ ID NO: 293 - DNA, 912 bp, Homo sapiens
  CDS (1)..(912)
cattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggatgccagaacggagggacgtgccacaacaacgtgcgctgcctgtgcccggccgcatacacgggcatcctctgcgagaagctgcggtgcgaggaggctggcagctgcggctcc

SEQ ID NO: 294 - protein, 304 aa, Homo sapiens
HYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGCQNGGTCHNNVRCLCPAAYTGILCEKLRCEEAGSCGS

SEQ ID NO: 295 - DNA, 1053 bp, Homo sapiens
  CDS (1)..(1053)
cattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctgccagaacggagggacgtgccacaacaacgtgcgctgcctgtgcccggccgcatacacgggcatcctctgcgagaagctgcggtgcgaggaggctggcagctgcggctcc

SEQ ID NO: 296 - protein, 351 aa, Homo sapiens
HYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSCQNGGTCHNNVRCLCPAAYTGILCEKLRCEEAGSCGS

SEQ ID NO: 297 - DNA, 759 bp, Homo sapiens
  CDS (1)..(759)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggg

SEQ ID NO: 298 - protein, 253 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGG

SEQ ID NO: 299 - DNA, 660 bp, Homo sapiens
  CDS (1)..(660)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggg

SEQ ID NO: 300 - protein, 220 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGG

SEQ ID NO: 301 - DNA, 540 bp, Homo sapiens
  CDS (1)..(540)
cgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagc

SEQ ID NO: 302 - protein, 180 aa, Homo sapiens
RCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDS

SEQ ID NO: 303 - DNA, 138 bp, Homo sapiens
  CDS (1)..(138)
cgctgcaagtgcaatggacatgcctcacggtgcctgctggacacacagggccacctgatctgcgactgtcggcatggcaccgagggccctgactgcggccgctgcaagcccttctactgcgacaggccatggcagcgg

SEQ ID NO: 304 - protein, 46 aa, Homo sapiens
RCKCNGHASRCLLDTQGHLICDCRHGTEGPDCGRCKPFYCDRPWQR

SEQ ID NO: 305 - DNA, 150 bp, Homo sapiens
  CDS (1)..(150)
gcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 306 - protein, 50 aa, Homo sapiens
ACDCHPVGAAGKTCNQTTGQCPCKDGVTGLTCNRCAPGFQQSRSPVAPCV

SEQ ID NO: 307 - DNA, 441 bp, Homo sapiens
  CDS (1)..(441)
agccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 308 - protein, 147 aa, Homo sapiens
SPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 309 - DNA, 1299 bp, Homo sapiens
  CDS (1)..(1299)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagc

SEQ ID NO: 310 - protein, 433 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDS

SEQ ID NO: 311 - DNA, 981 bp, Homo sapiens
  CDS (1)..(981)
cgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 312 - protein, 327 aa, Homo sapiens
RCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 313 - DNA, 1200 bp, Homo sapiens
  CDS (1)..(1200)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 314 - protein, 400 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 315 - DNA, 897 bp, Homo sapiens
  CDS (1)..(897)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgg

SEQ ID NO: 316 - protein, 299 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQR

SEQ ID NO: 317 - DNA, 909 bp, Homo sapiens
  CDS (1)..(909)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 318 - protein, 303 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGACDCHPVGAAGKTCNQTTGQCPCKDGVTGLTCNRCAPGFQQSRSPVAPCV

SEQ ID NO: 319 - DNA, 1047 bp, Homo sapiens
  CDS (1)..(1047)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 320 - protein, 349 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCV

SEQ ID NO: 321 - DNA, 579 bp, Homo sapiens
  CDS (1)..(579)
cgctgcaagtgcaatggacatgcctcacggtgcctgctggacacacagggccacctgatctgcgactgtcggcatggcaccgagggccctgactgcggccgctgcaagcccttctactgcgacaggccatggcagcggagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 322 - protein, 193 aa, Homo sapiens
RCKCNGHASRCLLDTQGHLICDCRHGTEGPDCGRCKPFYCDRPWQRSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 323 - DNA, 591 bp, Homo sapiens
  CDS (1)..(591)
gcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 324 - protein, 197 aa, Homo sapiens
ACDCHPVGAAGKTCNQTTGQCPCKDGVTGLTCNRCAPGFQQSRSPVAPCVSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 325 - DNA, 288 bp, Homo sapiens
  CDS (1)..(288)
cgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 326 - protein, 96 aa, Homo sapiens
RCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCV

SEQ ID NO: 327 - DNA, 729 bp, Homo sapiens
  CDS (1)..(729)
cgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 328 - protein, 243 aa, Homo sapiens
RCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCVSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 329 - DNA, 1338 bp, Homo sapiens
  CDS (1)..(1338)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcggagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 330 - protein, 446 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 331 - DNA, 2190 bp, Homo sapiens
  CDS (1)..(1350)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggggcctgcgactgtcacccggttggtgctgctggcaagacctgcaaccagaccacaggccagtgtccctgcaaggatggcgtcatgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 332 - protein, 450 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGACDCHPVGAAGKTCNQTTGQCPCKDGVMPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAG

SEQ ID NO: 333 - DNA, 1488 bp, Homo sapiens
  CDS (1)..(1488)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 334 - protein, 496 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCVSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 335 - DNA, 1200 bp, Homo sapiens
  CDS (1)..(1200)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagc

SEQ ID NO: 336 - protein, 400 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDS

SEQ ID NO: 337 - DNA, 1101 bp, Homo sapiens
  CDS (1)..(1101)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 338 - protein, 367 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 339 - DNA, 798 bp, Homo sapiens
  CDS (1)..(798)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgg

SEQ ID NO: 340 - protein, 266 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQR

SEQ ID NO: 341 - DNA, 810 bp, Homo sapiens
  CDS (1)..(810)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 342 - protein, 270 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGACDCHPVGAAGKTCNQTTGQCPCKDGVTGLTCNRCAPGFQQSRSPVAPCV

SEQ ID NO: 343 - DNA, 1641 bp, Homo sapiens
  CDS (1)..(1641)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 344 - protein, 547 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 345 - DNA, 948 bp, Homo sapiens
  CDS (1)..(948)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgtt

SEQ ID NO: 346 - protein, 316 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCV

SEQ ID NO: 347 - DNA, 1239 bp, Homo sapiens
  CDS (1)..(1239)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcggagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 348 - protein, 413 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 349 - DNA, 1251 bp, Homo sapiens
  CDS (1)..(1251)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcggggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 350 - protein, 417 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGACDCHPVGAAGKTCNQTTGQCPCKDGVTGLTCNRCAPGFQQSRSPVAPCVSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 351 - DNA, 1389 bp, Homo sapiens
  CDS (1)..(1389)
gggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcc

SEQ ID NO: 352 - protein, 463 aa, Homo sapiens
GGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRACDCHPVGAAGKTCNQTTGQCPCKDGVTGLTCNRCAPGFQQSRSPVAPCVSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 353 - DNA, 333 bp, Homo sapiens
  CDS (1)..(333)
acctgcaaggtgcagggcgcctggccgctcatcgacaataattacctgaacgtgcaggccaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctg

SEQ ID NO: 354 - protein, 111 aa, Homo sapiens
TCKVQGAWPLIDNNYLNVQATNTPVLPGSAATATSKLTIIFKNFQECVDQKVYQAEMDELPAAFVDGSKNGGDKHGANSLKITEKVSGQHVEIQAKYIGTTIVVRQVGRYL

SEQ ID NO: 355 - DNA, 333 bp, Homo sapiens
  CDS (1)..(333)
acatgcaaagtagaaggggcctggccactcatagataataattatctttcagttcaagtgacaaacgtacctgtggtccctggatccagtgctactgctacaaataagatcactattatcttcaaagcccaccatgggtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacc

SEQ ID NO: 356 - protein, 111 aa, Homo sapiens
TCKVEGAWPLIDNNYLSVQVTNVPVVPGSSATATNKITIIFKAHHGCTDQKVYQAVTDDLPAAFVDGTTSGGDSDAKSLRIVERESGHYVEMHARYIGTTVFVRQVGRYLT

SEQ ID NO: 357 - DNA, 333 bp, Homo sapiens
  CDS (1)..(333)
catcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagaca

SEQ ID NO: 358 - protein, 111 aa, Homo sapiens
HHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQT

SEQ ID NO: 359 - DNA, 780 bp, Homo sapiens
  CDS (1)..(780)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggc

SEQ ID NO: 360 - protein, 260 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKG

SEQ ID NO: 361 - DNA, 765 bp, Homo sapiens
  CDS (1)..(765)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaat

SEQ ID NO: 362 - protein, 255 aa, Homo sapiens
SCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 363 - DNA, 339 bp, Homo sapiens
  CDS (1)..(339)
gccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 364 - protein, 113 aa, Homo sapiens
AKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 365 - DNA, 1545 bp, Homo sapiens
  CDS (1)..(1545)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaat

SEQ ID NO: 366 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 367 - DNA, 1452 bp, Homo sapiens
  CDS (1)..(1452)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaat

SEQ ID NO: 368 - protein, 484 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 369 - DNA, 1791 bp, Homo sapiens
  CDS (1)..(1791)
aaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 370 - protein, 597 aa, Homo sapiens
KACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 371 - DNA, 1461 bp, Homo sapiens
  CDS (1)..(1461)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatg

SEQ ID NO: 372 - protein, 487 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINM

SEQ ID NO: 373 - DNA, 780 bp, Homo sapiens
  CDS (1)..(780)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggc

SEQ ID NO: 374 - protein, 260 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKG

SEQ ID NO: 375 - DNA, 765 bp, Homo sapiens
  CDS (1)..(765)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 376 - protein, 255 aa, Homo sapiens
SCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 377 - DNA, 1545 bp, Homo sapiens
  CDS (1)..(1545)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 378 - protein, 515 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 379 - DNA, 1452 bp, Homo sapiens
  CDS (1)..(1452)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 380 - protein, 484 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 381 - DNA, 1791 bp, Homo sapiens
  CDS (1)..(1791)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 382 - protein, 597 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 383 - DNA, 168 bp, Homo sapiens
  CDS (1)..(168)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 384 - protein, 56 aa, Homo sapiens
RKCNGHADTCHFDVNVWEASGSRSGGVCDDCQHNTEGQYCQRCKPGFYRDLRRPFS

SEQ ID NO: 385 - DNA, 687 bp, Homo sapiens
  CDS (1)..(687)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggc

SEQ ID NO: 386 - protein, 229 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKG

SEQ ID NO: 387 - DNA, 1119 bp, Homo sapiens
  CDS (1)..(1119)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 388 - protein, 373 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 389 - DNA, 1104 bp, Homo sapiens
  CDS (1)..(1104)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 390 - protein, 368 aa, Homo sapiens
SCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 391 - DNA, 960 bp, Homo sapiens
  CDS (1)..(960)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 392 - protein, 320 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 393 - DNA, 948 bp, Homo sapiens
  CDS (1)..(948)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 394 - protein, 316 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFS

SEQ ID NO: 395 - DNA, 936 bp, Homo sapiens
  CDS (1)..(936)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 396 - protein, 312 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYG

SEQ ID NO: 397 - DNA, 867 bp, Homo sapiens
  CDS (1)..(867)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 398 - protein, 289 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 399 - DNA, 855 bp, Homo sapiens
  CDS (1)..(855)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 400 - protein, 285 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFS

SEQ ID NO: 401 - DNA, 843 bp, Homo sapiens
  CDS (1)..(843)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 402 - protein, 281 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYG

SEQ ID NO: 403 - DNA, 348 bp, Homo sapiens
  CDS (1)..(348)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 404 - protein, 116 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFS

SEQ ID NO: 405 - DNA, 324 bp, Homo sapiens
  CDS (1)..(324)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 406 - protein, 108 aa, Homo sapiens
RKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 407 - DNA, 504 bp, Homo sapiens
  CDS (1)..(504)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 408 - protein, 168 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 409 - DNA, 1128 bp, Homo sapiens
  CDS (1)..(1128)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 410 - protein, 376 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFS

SEQ ID NO: 411 - DNA, 1104 bp, Homo sapiens
  CDS (1)..(1104)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 412 - protein, 368 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 413 - DNA, 1116 bp, Homo sapiens
  CDS (1)..(1116)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 414 - protein, 372 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 415 - DNA, 1035 bp, Homo sapiens
  CDS (1)..(1035)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 416 - protein, 345 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFS

SEQ ID NO: 417 - DNA, 1011 bp, Homo sapiens
  CDS (1)..(1011)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 418 - protein, 337 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 419 - DNA, 1023 bp, Homo sapiens
  CDS (1)..(1023)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 420 - protein, 341 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYG

SEQ ID NO: 421 - DNA, 1284 bp, Homo sapiens
  CDS (1)..(1284)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 422 - protein, 428 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 423 - DNA, 1191 bp, Homo sapiens
  CDS (1)..(1191)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 424 - protein, 397 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 425 - DNA, 507 bp, Homo sapiens
  CDS (1)..(507)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 426 - protein, 169 aa, Homo sapiens
RKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 427 - DNA, 1026 bp, Homo sapiens
  CDS (1)..(1026)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 428 - protein, 342 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 429 - DNA, 1206 bp, Homo sapiens
  CDS (1)..(1206)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 430 - protein, 402 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 431 - DNA, 1194 bp, Homo sapiens
  CDS (1)..(1194)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 432 - protein, 398 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 433 - DNA, 1182 bp, Homo sapiens
  CDS (1)..(1182)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 434 - protein, 394 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 435 - DNA, 1299 bp, Homo sapiens
  CDS (1)..(1299)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 436 - protein, 433 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 437 - DNA, 1287 bp, Homo sapiens
  CDS (1)..(1287)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 438 - protein, 429 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 439 - DNA, 1275 bp, Homo sapiens
  CDS (1)..(1275)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 440 - protein, 425 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 441 - DNA, 687 bp, Homo sapiens
  CDS (1)..(687)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 442 - protein, 229 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 443 - DNA, 663 bp, Homo sapiens
  CDS (1)..(663)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 444 - protein, 221 aa, Homo sapiens
RKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 445 - DNA, 843 bp, Homo sapiens
  CDS (1)..(843)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 446 - protein, 281 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 447 - DNA, 1467 bp, Homo sapiens
  CDS (1)..(1467)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 448 - protein, 489 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 449 - DNA, 1443 bp, Homo sapiens
  CDS (1)..(1443)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 450 - protein, 481 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 451 - DNA, 1455 bp, Homo sapiens
  CDS (1)..(1455)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 452 - protein, 485 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 453 - DNA, 1374 bp, Homo sapiens
  CDS (1)..(1374)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 454 - protein, 458 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 455 - DNA, 1350 bp, Homo sapiens
  CDS (1)..(1350)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 456 - protein, 450 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 457 - DNA, 1362 bp, Homo sapiens
  CDS (1)..(1362)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 458 - protein, 454 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 459 - DNA, 1623 bp, Homo sapiens
  CDS (1)..(1623)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 460 - protein, 541 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 461 - DNA, 1530 bp, Homo sapiens
  CDS (1)..(1530)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 462 - protein, 510 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 463 - DNA, 723 bp, Homo sapiens
  CDS (1)..(723)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggc

SEQ ID NO: 464 - protein, 241 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKG

SEQ ID NO: 465 - DNA, 1488 bp, Homo sapiens
  CDS (1)..(1488)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 466 - protein, 496 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 467 - DNA, 1062 bp, Homo sapiens
  CDS (1)..(1062)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 468 - protein, 354 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 469 - DNA, 903 bp, Homo sapiens
  CDS (1)..(903)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgat

SEQ ID NO: 470 - protein, 301 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAAD

SEQ ID NO: 471 - DNA, 891 bp, Homo sapiens
  CDS (1)..(891)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggc

SEQ ID NO: 472 - protein, 297 aa, Homo sapiens
RKCNGHADTCHFDVNVWEASGSRSGGVCDDCQHNTEGQYCQRCKPGFYRDLRRPFSLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKG

SEQ ID NO: 473 - DNA, 879 bp, Homo sapiens
  CDS (1)..(879)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 474 - protein, 293 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYG

SEQ ID NO: 475 - DNA, 1071 bp, Homo sapiens
  CDS (1)..(1071)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctca

SEQ ID NO: 476 - protein, 357 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFS

SEQ ID NO: 477 - DNA, 1047 bp, Homo sapiens
  CDS (1)..(1047)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 478 - protein, 349 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 479 - DNA, 1059 bp, Homo sapiens
  CDS (1)..(1059)
agctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggc

SEQ ID NO: 480 - protein, 353 aa, Homo sapiens [sequence omitted]

SEQ ID NO: 481 - DNA, 1227 bp, Homo sapiens
  CDS (1)..(1227)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggc

SEQ ID NO: 482 - protein, 409 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYG

SEQ ID NO: 483 - DNA, 1242 bp, Homo sapiens
  CDS (1)..(1242)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 484 - protein, 414 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 485 - DNA, 1230 bp, Homo sapiens
  CDS (1)..(1230)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 486 - protein, 410 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 487 - DNA, 1218 bp, Homo sapiens
  CDS (1)..(1218)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 488 - protein, 406 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 489 - DNA, 1410 bp, Homo sapiens
  CDS (1)..(1410)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 490 - protein, 470 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 491 - DNA, 1386 bp, Homo sapiens
  CDS (1)..(1386)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 492 - protein, 462 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 493 - DNA, 1398 bp, Homo sapiens
  CDS (1)..(1398)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 494 - protein, 466 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 495 - DNA, 1566 bp, Homo sapiens
  CDS (1)..(1566)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 496 - protein, 522 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 497 - DNA, 1887 bp, Homo sapiens
  CDS (1)..(1884)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 498 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 499 - DNA, 1830 bp, Homo sapiens
  CDS (1)..(1827)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 500 - protein, 609 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 501 - DNA, 1815 bp, Homo sapiens
  CDS (1)..(1812)
atgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 502 - protein, 604 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 503 - DNA, 1743 bp, Homo sapiens
  CDS (1)..(1740)
gggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctag

SEQ ID NO: 504 - protein, 580 aa, Homo sapiens
GPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 505 - DNA, 1317 bp, Homo sapiens
  CDS (1)..(1314)
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 506 - protein, 438 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 507 - DNA, 1233 bp, Homo sapiens
  CDS (1)..(1230)
cattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 508 - protein, 410 aa, Homo sapiens
HYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 509 - DNA, 1743 bp, Homo sapiens
  CDS (1)..(1740)
atgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcctga

SEQ ID NO: 510 - protein, 580 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 511 - DNA, 1353 bp, Homo sapiens
  CDS (1)..(1353)
atgcagccgccaagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggccaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctcgtcccgctcctggccctgctccctgtgttctgctag

SEQ ID NO: 512 - protein, 450 aa, Homo sapiens
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQATNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 513 - DNA, 1314 bp, Homo sapiens
  CDS (1)..(1314)
atgggcttgagagcagcaccttccagcgccgccgctgccgccgccgaggttgaacagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgggtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtag

SEQ ID NO: 514 - protein, 437 aa, Homo sapiens
MGLRAAPSSAAAAAAEVEQRRRPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHGCTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 515 - DNA, 1281 bp, Homo sapiens
  CDS (1)..(1281)
atgggggagccaggccagtcccctagtcccaggtcctcccatggcagtcccccaactctaagcactctcactctcctgctgctcctctgtggacatgctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaa

SEQ ID NO: 516 - protein, 426 aa, Homo sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 517 - DNA, 1176 bp, Homo sapiens
  CDS (1)..(1176)
ggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgggtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttg

SEQ ID NO: 518 - protein, 392 aa, Homo sapiens
GDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHGCTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 519 - DNA, 1173 bp, Homo sapiens
  CDS (1)..(1173)
caatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcag

SEQ ID NO: 520 - protein, 391 aa, Homo sapiens
QCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 521 - DNA, 3156 bp, Homo sapiens
  CDS (1)..(1884)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagctgcacggccactacatgtggacaaaagtgaacatataaaagaagttgtgctatttaactctgaatacttggagaaactaggtgaagatgcaaccagaaaggagaatatgtatgcgtgaagtctcagctttgagckggaggctagaaagagcagccagagaactttttaaaaactaaccagaagagctttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaa

SEQ ID NO: 522 - protein, 628 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 523 - DNA, 3099 bp, Homo sapiens
  CDS (1)..(1827)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaatttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagctatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagctgcacggccactacatgtggacaaaagtgaacatataaaagaagttgtgctatttaactctgaatacttggagaaactaggtgaagatgcaaccagaaaggagaatatgtatgcgtgaagtctcagctttgagckggaggctagaaagagcagccagagaactttttaaaaactaaccagaagagctttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaa

SEQ ID NO: 524 - protein, 609 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 525 - DNA, 864 bp, Homo sapiens
  CDS (1)..(864)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatg

SEQ ID NO: 526 - protein, 288 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHM

SEQ ID NO: 527 - DNA, 939 bp, Homo sapiens
  CDS (1)..(939)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggggagtgggaggatgcgcaggggttttctgcacttctacactcaggtaaatgcgaatgtaaggaacagacattag

SEQ ID NO: 528 - protein, 312 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMGSGRMRRGFLHFYTQVNANVRNRH

SEQ ID NO: 529 - DNA, 26 bp, Artificial Sequence
  Description of Artificial Sequence: Synthetic primer
ttctagacatggggagctgcgcgcgg

SEQ ID NO: 530 - DNA, 25 bp, Artificial Sequence
  Description of Artificial Sequence: Synthetic primer
cattaacgtcgaactgacaggtatc

SEQ ID NO: 531 - DNA, 25 bp, Artificial Sequence
  Description of Artificial Sequence: Synthetic primer
agcactgtgccccgttatacaatga

SEQ ID NO: 532 - DNA, 34 bp, Artificial Sequence
  Description of Artificial Sequence: Synthetic primer
cgggatccacttgcactctctttttaaaatatcc

The invention claimed is:

1. An isolated protein comprising one of the following sequences:
SEQ ID NO: 522 or SEQ ID NO: 524.

2. An isolated nucleic acid comprising
the nucleotide sequence SEQ ID NO: 521, or the nucleotide sequence SEQ ID NO: 523.

3. A recombinant vector, selected from the group consisting of plasmid, cosmid, phage and virus DNA, comprising
the nucleotide sequence SEQ ID NO: 521, or the nucleotide sequence SEQ ID NO: 523,
and the elements necessary for expression in a host cell of polypeptides encoded by said nucleotide sequences.

4. A host isolated cell selected from the group consisting of bacteria, viruses, yeasts, fungi, plants and mammal cells, said host cell being transformed by a recombinant vector comprising
the nucleotide sequence SEQ ID NO: 521, or the nucleotide sequence SEQ ID NO: 523,
and the elements necessary for expression in said a host cell of polypeptides encoded by said nucleotide sequences.

5. A pharmaceutical composition, comprising as active ingredient a protein comprising one of the following sequences:
SEQ ID NO: 522 or SEQ ID NO: 524
and a pharmaceutically acceptable vehicle.

6. A combination product comprising
mutated netrin 4 as set forth in SEQ ID NO: 522 or SEQ ID NO: 524,
in combination with an anti-angiogenic agent AVASTIN (bevacizumab), MACUGEN (pegaptanib) and LUCENTIS (ranibizumab), or any other anti-VEGF agent.

7. A pharmaceutical composition comprising as active ingredient the nucleic acid of claim 2 and a pharmaceutically acceptable vehicle.

\* \* \* \* \*